United States Patent 10,407,724 (METHODS AND COMPOSITIONS FOR SCREENING AND TREATING DEVELOPMENTAL DISORDERS) - sequence listing, part 2

SEQ ID NO: 14 - DNA, 184264 bp, Homo sapiens
atctggaccctgatcttctggtgggtttaccagttacttgtagagtgtccctgtgatagttttaggtgtcaacttgacaggattgagggatgcctagatggctggggaagcactgtttctgagaaggaccatgtttttggaggagactgttttatgagtgaatttcaggggacacattcagatcatggcagtggcattataaagagagacacaaaagcttgctctctctctctgccatgtaagactaccacacaaagactgccatctgcaaaccagaagcaggtgggctttcctcagacaccagatctgcctgcaccttgatcttggacttgccagccttcagaactctaagaaagaaatggtagcatggcttggtctaagttggaaggcctgagaaacaagcacatggtggaactgagttcaaggataaagacttgagaatacctgctcagtggactgagtagggaagatcaaccctcaatgtaggcaggcactatccaatcacctgagggcccagatggaacaaaaaggtggaagaagggtgaattctctcttccagagctgtgacacccttctcatgcccttgtaccacacaactctaggtcctttggcctttggactctgacacttgcaccagtggccctctggggctctcaagcctttagccttgaacttagttacaccatgtgcctccttgtttctcaggccttccaacttggatcaggccatgccaccggcttctctgattctccagcttgcagatggtatattgtgaccctggcatttaataactatgactttggtcttaagcaattttcttcctctgtggattgatatttacatatcaatgtggataataatttcttaccacggtaactgttgtgaggtaaaaatgagttaacataagtaaaaccgagcacatgcaaaccatccgaaatggttaatacttactatttgtacttgaagaaataaatgtttttgacaataaacttcttgtgcagttttcctcagccagtgtcaactgagccgatcatttatgtgacagtttcattaccaaatggatgttctcaccactatttcaagtgcagtatgaaactttatttgaaattctaaaaaactaattaattaattaaggttgtttggctcttgcagcctgtattaatttcctagggcagccgtaacaaaggagtcacataccacatgacattttggtcagcagcaggctgcgtttctgacagtactccatacaattataacaccattatttttacggtaccttttctatggttagatacacaaatacttaccgtgttacagttgcctacagtattcagagtacagtcacatgctgtactggtttgcagccccggcgcattaggccatgccgtgcagcctagctgtgtagtaggctctcctggctaggtttgtgagtgtgccctctatgatgttcacacaacggcctaacgatgcatttctcacaacgtatccacgttaagtgacccatgactattcattctacaaactgagaagcttaagtaacagaaatttattttctcacagacttggaagacagaagcctgaaatcaagttgttagtagggccattgccctctgaaggctctagaggcaaatcttttcttgcctctttcagcttccggtggctcccagcaatccctgacattcttttccttgtagtaacacaactctaatccctacctcagtcttcacacagtgttctcccctgtgggtctctcaatctctcactcctcataaggacaagtctttgcattcagggcccctcaaatccagtgtgacctcatcttaatttgattacctttgtaaagatgcaatttccaaataaggtcacatttgtatgtactgcgggttaggacttgaacatatatttttagggggcacaagtgaacccacatcagaggtcaagccacaaagcagcctacatggcgaaaccagtcttgtcgtgaaaatgtaaactgaggtaagggccatgctgccttggaaagcgttctgtgttgtcattccagagccacgggggctggatagtgacaacagaggtgggttgcagatctatgggctactctttgcagaggcagtaagtagggactgccacagcattcaattaatttcctgtaagaatacattttattcaagttgataaaaaagctatacttattaatattgcataacattcctgtgctatcaaatgagaatctccagaaatgaatttgaatagctataaaacccacatttttctgcagatacatgtgtagccacctgagagccaggtccctcagtgtccacagacatagccctgccacctaccgcctgcttcccagagcaatgaagcttctgctaactcaggcttatcccagtctctatttcaggccatcagctggatgaagaattaatttagtaagcatgaaacagcttgcaaagcattggtgagtggctgagggccatgaaacgagaccaccgtgtggcccatctctgaagatgaatccaacagcagtgactctacctgcgtcctccccatcttttctgctttttcatacaatggcttattcactgcgtgtgacatcatcactagcactgtgtttatctatcacatttcttctgttttgtgggtttgttttgcattaaaggtctacttctctgagctttgagctgtaaggcttgactgtgagcagcaactgaagagtgtggcacctcacactcggtaggaagaagctgaatgacagatgtcggcagtgagggtggggaaagcagccaggtaccaagcagctgttttttaggctaaccattgaagggaagctcctaatccctgagttaacttttagcagagattaactcagtctatctattgggatgtaaaggatttgggcataaaggtatgttaattcggaggctctggaatgtataacaatttctcccattgaaatttatgataattaagtgttcaacttactggaattttccccacaagactcttctgggatgaatttgccttggggagaagactacgtaactgaaaaccagcatccaggccctcaagaagaaatataatctccaacagtctccttttcaatttctgtcaaatgtctggcttctcttgaagggatgttcacgagaagggacagccgccctcctccgagcctcctgtttcagctgatgcaccttcaagtacaaggtcctgttcttgggctctgttaaagtttccctcaagaaaaaaaccttacatttgccaatgcacttgatgtaaagttgttgaggatgttgactctcctttaaacatttattgaagctaggaataaacttaactggacctgtgtataggaaatcttaaatttctactaagagatgaaaaaaagaattcccttcccttccttaacaattcagctcccgttacacaaaaccaaacaagatgggattctgttgtggggggacagaacttcattgtcctgaagctaggtgttggagcccaagcagggtgaggagggagtcaaggaggcccatgtggtggtggagcatggcctggcatgggtctcagtgcccaagcaaggtgaagaggggaccatgcagggagtgagggtgtcactgcccaagtgaggtgagtagggcaattttgaaaagtcatgaaagttgaggaagggctgaggcaccattctagattgaaggagactaaaaagatgcaacactcacaatgcacaattctaaactgaaatctttgctctaaaggacattaggacaatgaaagaaacttgcacggggtctgagcattaggtagtagtaatgaattgatgttgagtccctaattttcatggttgtatgctgatgatgtaggaggttcttgtaggaaatacacactcaaaagtattctgaggtgatggggcatcatatcagaagcttattctcaaatggttcaggaaggaaaaagttttatactatacttctttggcaagtttagattgtttcaaaataaaatttttttaaaaagagcatttgttaaccatcagtttggtaaaaggtgaaaaatgttgataatacctagtgtttgtgaaggtgtggagaaacaaagtttcatacactattgtcaaaagtataaattgttacaatatttttggagagcaattttccagtatgtagcaaaaatttaaaagcaaatcttaactcagcaattctgcctttagaaatgtatttgtaggataacatacaggagagaaaaatgtattttactgcaacactgttgatactaacaaaaactggaaaccaccaaaacatttatcatgagggggttaagtaaagtatggtataactatacaatgagtgtactaggaaacccttagaaagaatgcagaaagatgtatgtggacttttacagaaaggtgagctactgtctaaatgcaaatgtgccaatatcatgtatatacagtcaggttccttttgttaaaaaccaaaagcgtatgtttagaagcaaaagcactcatataaaggcctggtatagagcagtggctaaaaacagtgccaagatactgcctcaacttcctctcacatgctgccctggtgatactgaggctggttcaggaaccatgacagcctgtttgtatgaattccttaaagcacaaattacttagtttctttcataacagtcacctaatcccttagtttaaaatggttgtgttcatggaatactatgcagccataaaaaaggagatcacatcctttgcagcaacatgagtggagctggaggccattatcctaagagaactaatgctgcaacggaaaaaccaaataccgcatgttttcacttacaagtgggagctaaacaatgagaacacatggatacaaagaggggaaaaacagacactgaggcctacttgagggtgaagggcaggaggaggaagagtatcagaaaaaattcctattgggtactatgcttattacctgggtgatgaaacaatttgaacaccaaatccctgtgacacagtttacctacataacaaacctgcacatgtactcctgaacctaaaagttacaataaataaaaaataaaatggttgtgtcctgacaggaaataagtgttccagatctgcttgcctcctacccccttaagaactcccagcgccaaggacagcttcacagtgatgtgctgaatttgttttttctctgccccacccaccattttgcttctggtaagattttgaatccctggttaattaatgaagaactaaccttacaatgggtatatgcttgtggtccctttccaccagcccccagcccacctaacatactagttgtgggactgcctaaagaaagaatgtcaggaaggccagagaggcgagctgaggatccccaggtggaggcctccacagtaagtgccacaaggccattgcatcatgagggcgtgttccatgaagatgttctagccatggtgtttgtccactgtcccatgtgcctgactgcttgggcacagtggacagtggtcttagccaaggcctagttatgttcaggggcagatccctggcttctcctaaatgcactggccgtgaaaaggggcagtcagcttcagagggagttgaggagctggggatggggaaggctttgaagatgcccctcaaagccccactggatgtcaatcagccagtttccagacaagataaactagataacttgcaggattctaggtgtgggtagagatgagaatcaaactgggaaacgtaactcttcccatagaagcagctaaaatggctgggcatggtggctcaggcctgtaatcccagcactttgggaggctgaggcaggtggatcataaggtcaggagttcgagacaagcctggccaacacagtgaaaccccatctctactaaaaatacaaaaatgagccgggcatgtggtgggcgcctgtaatcccagctactcaggaggctaaggcaggagaatcgcttgaaccctggaggtggaggttgcagtgagccaagatcccgccactgcactctatctagcctgggcgacagagcgagaatctgcctcaaaaaaaaaatagaagtagctaaaacaatttgtgtgtgtgtgtgtgtgtgtgtgtgtgtgtgttggggttggggaggaaggtgttaagatcacaggaataaataaaaatgttagcatagtattgctatcacagtatttctgttgttacatgcttgagtcaatctttgtttttagaggaaaaaagcgtccagaaaaagaaggacgctggaacctaggaactccatgatttgtgctgaggtttttttgttttttgttgcaatggtgtattctgaggacagggtctaagaaataacttcttagttattcaaatgacttctgaatgaaacattaaaaatactgaattgaaatgaccccaaaacgtcttaactattagcaaatagctaacctcttgtatcccagatattgttttgtggaaagaaaatgaacttgctggataagagaccaactgaaacaaaatggaaagcatggcagtgtgctatatccatatatatatacacacacacacacacatatatatatacatacatatatatacatacacatatatatatacatacacacatatatatatatatatatactttttactaaggctaggaacttgaggcgaggattttttctttcccagtttggattccctttagaattttgggttcagacaacaacttttacagttcttgaaccaagttcccttttactgaaagttaacaaaatacaaagaggggctgtgggctgtgggctgtgaaaggattctgtagaaaattgtaaggcccagattaagagcatgcagacagcagtctatcagtcagattctaacctgaaaatcagaaaccactcaagtgttcagatggaagaaatctaatgcagagaataggtgacacactcagagtcaacatcagagaaagcactgccacagatgctatcagacacagcttttaaactaaaaatgctactatgttcaaggaaaataaagctacatttgagaatctggcatactatgaaaaaggaagaaggtccagtgctgtggctcatgcctgtaatcctagagctttgggaagctggggtgggcagatcacttgaggtcaggagtttgagaccagcctggcaacacagcacaacccctctctactaaaaatacaaaaattagccaggcatggtggtgcacacctgtaatcccagttacatgggaggcgtaagaattgcttgaacctggaaggcagaggttgctgtgagcccagattttgccactgtactccaaccttgggcgacagagtgatactccgtctccagaaaaaaggaagcaaatgaaaagtctattactgagaaacagaaaaacttaaattgagcactcaatgggtatatttaagccagattacatagctaaagagaaacttagtgaactggaaggtaaattagatccagaatgaagcctgggtaaggagtaggggacaaaaggatggaaacgagcacttaagaggcacaggagatacagtgagaaggctttatttggagtcctagaaggaaatgaaaaaagaatggtatagagctaatatctgagcacacaatggctgagaatttaccaaaactcatgaaagataaatacacaaatttaaaagcccagagtatacaaaaaaggatcacttataaaaaatccacaccaaaataaaacacagtgaaactggaataaaccgaagattaaaaaaatcttaaaagaagctattttaaaaagaatacattaaactggcagatgaacagccagagtggaaatcacacttcagtggcttaatgcatccaatgtgacaaaagaacatgaggtctaacctagaattctattcccacaaaaaaccatttttaagaatgaagttatttttaggcaaataaaaattgtgaagttttacctctaacaggacagagtattctaaagaaagttttctagagagaaggaaaatgtccccaaataaaaaattgcagaggtggagaagaatgaaaggaaatgaaaaggttgggcatggtggctcatgcctgtaatcctagcaatttgggaggccaaggcaggtggatcacctgaggtcaggagttcaagaccagcctggccaacacagtgaaacccccgtctctactaaaaatacaacaattagccgggcatggtggtgtgtgcctatagtcccagctactggggaggctgaggtaggagaattgcttgaatctgggaggtagccattgcagtgagccgagattttgccactgcactccagcctgggtgacaaagcaagactgtctccaaaaaaaaaaaataaataaataaatttaaaaaaaaagaaaagtaattaaacgtttggtatagaaaataataacatattttaatatatatgtacatttatatgtatatataattaaaattaaccaaaacaacagcatataggatggaaggtaagaagtattctaggaactttgcattgtctaggacgaagataaaagtatcaattaacattaggctttggtaagtcaagaatccaccttttaattcctaggccactaaaagaagagaaaaagtatataacttccaaaccaaaagatggaaaaatagagtatgaatagaatcattcataactataaattaaagggctaaatgatcctgttaaagtaagttatcagactggattaaaacaaactatatgctatttccaagaggtacatctaaaacataaaaatacagaaagcgtgaaagtaaagaaagagaaatgccatataacggtaaccaaaaaagaagctgatgttattaataccagaaaaaaagagacttttagtaaaaggcattactagggataaaaggtttacttcataaaatttcaattcatataacaattttatatttgtgtggcctcaaatatataaagcaaagttcacagaactatatctaagtagagataactcaacaattgtctcattaatagaagcaaataaaacttcattaagagcagagaagatatgaacaacgtattacaatctaatggctttatgtagatgactgcatgcggcatctgcagaacatgcattcttttcaagtgcccacaaatcttcactaaggttaaacacatgctgggccataaagcaaatctcaacacaattcaaaggacagcagtcacatggaccatgttttgtaacaacaataacaaaaatataactaggaaattcccatgtttggaagttaaaaaatatacttctaaataagccatggaatctgttgtgatttcccaattttcattcctgactttgattatttgtgcttttctttctcaatcacatcagaggtttaccaattttgtcttttcaaagcagcaaccttgactttgttgttctttgttgtgtttgctgtttcatcaacttttgctctcattcttatctccttcaacttttaaaaagatagtcaatttaacaacgtttgtacaaaatttttataaagtacagagcatttttattaagccttaaaataatcttgtaaacaggtcttttccctcattttacagatgggaaaatgacagaacaggaaataaatccatattattgcactgaatggaatatggccccatggtttgcacccaagaccagaggaacttcacctgctcctctctggggctttgccctgcccaccccaggaccactacttatcctctgagatcttaagggacactcaccagaaatagccatggttaagatggtaaaagtctggctctcaccaacccttcctacagtaatctccagcacatctgaatattgctgggaaaacacaggggaaacaagatgtgtaccatgtgagtgagcaggctgcccaggccagaaaggcaagcgtgaggcagccctcaacccccaacgtgtggttactggcctcagctggaggctcctcctgctgagcccttttgcagcccgacaaagacaaaacatgtttgtttagagacaatggattgcttacttagaagcaagataccactcaggaacatccaaaaaataacttttctcatgtttcttctcaagttttgtctgagtagggggtggtccttgagggatttccttgacttccaggtaagagttgtcctccactgcccaagcatctagatgctgagtctttggacagggccaccacacttcagacttattccatacattcttatgcaaatacttctcattctaggcagccttctaaggaccttaacactattaatgtttccaaccctcattacaacctgaggttgctactattatctttacaaaagacaggtgagggcccagtatggtagcctgtggtggttcaggcctgtaatctcagcaccttgggagtctgaggctgggcagattacttgaggtcaggagttcaagaccagcccagccaacaatgatgaaaccctttctctaccaaaaataccaaagttagcctggcatggtggcgcatgcctgtaatcccagctactctggaggctgaggcatgagaattgcttgagctcaggaggtggagactgcagtgagctaatgcccctgcactccagcctgggcgacagaacgagaccgtcttaaaaaaaaaaaaaaaaaaaaaaaaaaaaaaaaaaaagacacgtgaggacacacaagtttagttacttgcctaaagtcatctggaaataagtgaaagtccttatttgaactcaggcttccttgtggagaccatgtcctcggccactatacttcactgactctacacaggtttcatgcaaacggcttccttcgcacaatgacactatccagacctgagaaccgccaggtctaaatgagaatggctcctcagtaggaagacaattgaagtactgtattctgcttccttctccatgtctctaggcctttagctgaagctggagaagagaaatgaagggtctccccagcccaggaactccttgggtacagctgtggccaattactcaaggtcttgatgcagacagacttcaggtccccaatgtctgccttcagctaacaccatcttcaggtgttgtcctggtggtgatcctctcatttctgaatcccacggaggaaaattcccctgcattgcaggattggtgttcagtaccgtttcacgcccagtgtcttcatacacaaaacatgaaattattttccaggctttcaccttcagacaaatttgctaatagagacatgcactcctatggaaggctattccatactcactgttttttcaggcttttcttttctctttctcctccccgcttttccctccccctttatttttcccacttgcatatcgttctctggaaggaaccgggggtggtgcctaaaccatgttccatccctggtctgagcaggctcagccgcaccagttcattgggtctgtgctacaagggagaccccaccatgtctgggatcagcctgaatggcttgtatctggctgtaggtacacttgaggacctgggcccatttctggagcatgcgagtagatgggggccgcagtaggagcttgtctggtgcttagtggggctgaggcactcagaatccccacctgagctgtggccatcctctcctttgttatttagcctgcatctccccaaaagtagacagtgcattaggttcagctggagctcaagtacgggagctctcctgtgtgaggagcacatggaaacctcaggttaaaaacaaccaaagctggtctcatcttcagcaaaaagaagcccaatccatgtccccacgactacggggaacgagtactccatggcaccctccttcctgcccacacatcagccctgccagagaccagccttgctggaggatgcctgggcacttccgtagctgcctttactcaggtcatcctagttcctactcctctcagaaaacccaattcaacgtcctgcccagatgtcaccaattcctccctcttggttggtcctagtcgctgtcctctgagcacctgcagtcttaattcatccattagggtggttgtgctcacagcctttctccctttattcatcctcatctaccagaatctactcctgctgccatcctctcccacccagtacctgggacagggacagtgcctagtagatcctcaagtatttgctgaataaatcagtccaagtctgtgtatagggtcaggcttgccagtgtcatgtgcaaaggaggatagagagcaagtatgatcagaacagtccaagtggagcagtggtagaaatgctccatctccctttcctccctcaactccacccttccccaccgcagccatcaaaacttactggtaggggtttggatacaaagtgaaacaaatatactcctagaaagagcatggaaactatctggctacagagataggagtcccagaaggagatgggaaactacatggctgagattgttctcttgtaaagacaatgggttttgaaaccagataccagacttcaaattcagcctttgctgattggcccactcacagtattctcagacaggttactcaattctcagaagagtctatttttaccctttgagttacctagttaacagcttcatacacagcagtagtttatgttcaattctacatgttcctgacagagctgtgtgtggtgactgatcactcacacaacctacctgctcccgagttaggatctggcccagtaacgacgatcacatggctccactgtggtcccctcaaaatctatcctgtgctcctcctagggaggcaccttctaacttctggtgaaaccagctgagctgctagccctgtgggatgagtctactaccctctctggtttggatctggtataacttacccaacaaagatctggcacacaaatggctcttgggtatcctccatctaaactcacagcccgttttgatttaaggaatttctttattggaattccactttacctcgccacaaggagctggctttcatgacaaagagagagtgagccctgaacaaagtattcgttaacattttacaacagacaacatatacatgtcctgcatgacatctttacaataacacattccaaaaacaatcaaacatttaacaggattattaagaaacattaatttccttctctctagatgactggtactttagctttttagcttctgcaataaaatgcgttccttctcagcatttctattcataggaatccctgaatcacttctgtcatgtaaggtgcgaattcatgttgacggtgtgttccattagttactgaatgtgtcaaaatcctctccacggtagaaccttttattgtagcataatgtgtgaataccacttccaggttatccctcatcacaaattcatcattcattatgggagttcatctgaaactttaaaaaagtttcatccattcaactaatgtatcacaatagtacgttcatcaatttgcattttttatgagtgactctctcctatctcctgttagacttgtaagtctatgctttctacttttcctaaaaggaaatccaaattttgtttcagaagtcatcatcactgccccctcccaaaccaattacatcaagtttatacttaaagaccactaatattaaataaatttatattccctgaaacctatcctccctgaatttgcctgttggaggcccttagttttcccactgaccaatgtgtaattgggattcaaagctatacctgaatttcctacatttctagtaacagaatttaccaaacatgaactttctgatggtgattacgtaacttctaattgaagccctttcctcatctgtgttttatgtccagaaatgtctactgattttgaagatttgcttcacattccatcactcagatctaagtttttctctcaagtatggactgttttatatcctgtaagagctgaactaccttgacactggagcctttcttgcttgctatgattgaaaatcacatagaaaggattcctcataatcctctaggatggtttcatttacactgtgtaaattacaagccatgaccccctacattcttacattcataaggtatttcttccatttgagttcggagagacttggtaagctctgcctgctacagaggcatcctcatcctgcccccatccagggcattccctccctcataggttctcttctgggatgtgccactataacttcccacatatatcacatttaaagattcctctccagtatgggttcttttatgcttggtgagatttgatctgatattaaaagccttaccacactcattacatcggtatggcttctttccagtgtggatccttttgtgctggtcaaggactgatctataattgaaggatttcccacactcacaattatagggctgcttcccctggtggacacttttatgattgataagacttgagtgtgagatgtatgccttcccacactcatcacattcatagggtttctcacctgtgtggatccttttatgcactgtgaggcctgagctgttcctgaaggccttcccacacctatcacacacatagggtttctcccctgtgtggatcctcttgtgctgagaaaggagagagctgtaactgaaagatttcccacactcaacacacttgaagggtttctccccaagatggactcttttatggcttataagagttctgcttgagaaaaaagcttttccacattcatcacatgtatggggtgtcctgccagggtgggtactcttatggttaataaggcttgagtgtgagatgtaggcttttccacacacatcacattcatagggcctctccccagtatggattcttttatgaactttaaggcttgagttgtttctgaagaccttctcacacctgtcacattcatagggtttctctctagtgtggacccttctgtgctgagaaaggagcgatgtgtaattaaaagatttctcacacacatcacatttgtagggcttctccccaagatgaacttttttgtggtttgtaagggttcggtatgtgatgaaggccttctcacactcgtcacacttaaagggcttctccccagggtgtacacttttatgatttataaggctcgagagagagatgtatgctttcccacattcttcacatttgtaaggtcgttccccagtgtggattcgtttatgtactttaaggccagaattatttctgaaagctttaccacactcatcacacccaaagggtttttccctggtatgaatccttttatgctgttcaagggcagagctgtagttgaaggatttctcacaatagctacatttatagggcttctccccaaggtggattcctttgtgatttttaaggctagagcgtgagatataggctttcccacacacatcacacttatatggtttttccccagtatggagcctcctgtggactttgaggcctgcattgtttctgaacgttttcccacacacatcacatacataaggtctctctccggtatgaatagttctgtgttgaagaagtagtgagttataactaaaggatttcccacactccttacattcatgggctttcttcccagggtgaatgcttttatggactgcgaggcctgagctatagctgaatgctttgccacagacatcacacttgtaaggtttctctcctgtgtggatccttttatgcactatgaggcctgagctgttcctgaaagccttcccacattcatcacattcataaggtttctctccagtgtggatgactttatgctgaatgagaagagagctataattaaaagatttctcacactcatcacatttatagggtttatctccaaagtggatgcttttatggttgagaagtgttctacaagtaatgaaggccttcccacactcatcacattcgtaaggtttctcacctgtgtggatccttttatggaccctaaggccagagctgttactgaaggttttcccacagatgtcgcattcatagggcttctcccccgtgtggatccttttgtggactctgagcccagagctgttcctgaaggccttcccacactcaccacattcatagggcttctccccagtgtggatccttttatgctggtccagaacagagctataattgaaggattttccacattcatcacatttacagttcttctccccagaatgggtgcttttgtggtttataaggctggagtaggacatgtaggctttcccacattcctcacacttgtacggcttctccccagtgtggatccgtttgtggacccgaaggctcgagctgctccggaaagtccctccacagtcatcacattcatagcgcttttccccagtgtgcataattttatgttgaacaaggcgggaattatatttgaaggatttcccacattcatcacatttatgtaatttcttaacagcattggttttctgctgtagactagggtaggaggttccattaatgttctccacacgtttgccttgctcactgcctctctgtcctataggcatagtctggtgtgtgatatgctgtgggctcagatgcaagctcttctcagatgcctcaccttcctgttctgtctttatatttgctgtactcttggctttgctgattgcttccctgatgctgcttttgtcctccttcatcctgttttccacaggctttttctgttgattctctaccttgctatcccaaacacatgtgtcaccaaccttagattcaggcataggatcctccacttttggccacttagatgctgcatttccaacattttcatattcttcagttggttcctcatcctcagtgctcgtcttcaaatgtgacactaaaccaagaaaatgaaaaggacacctattcactctcttaaaaaaaaacaaaaacaaactggaataacaatgaacaacattcacttgacaaacatttactgacaacatactgtgtgacaggtaccatgtgccatgtaccggtttttaagtactagggatacaacaatgaatatgacaaaatttctgcccctgtggaactaatgttaaaatgctagaaccctggattttcaatggaacaatgagcttttctattcttgcataacagcttagcatagggcagggtgaaatgatgcacagaaccatgggcaacaccaatcagtttttaaacaatgtcacccagtcatggaaaaacaaacaagagggcagaagaaatctctgaagaagacagaaaaattcataagtaggacaaaagttaggtaaaacttttttttattatgaaaagttagacaaaatcagcagaggacagacaaaactaaagagaaaaaattagtacctggggaggggtatcagggagaaggctatgaaaccatgaagacagttactgcagagatgaggaagaaggcaacctgcatattaaaatatattattaaacgtctataattaaaatagtatggtcctggtacatagacaggcaaatggaatagaacaggaagtccagacattgtcccaggtagacacagaaattaatgatacagatgatatctgaaattaccagagaaaagatggtccttttaatagtgttgtaacaactatgaagccatatggaaaaagataaaattaaggctgggtgcagtggctcacacctgtaatcccaccactttgagaagctgaggtgggcggatcacgaggtcaagagatcgagaccatcctggccaacatggttaagccgtctctagtaaaaatacaaaaattagctgggcgtgatggcacgcacctctaatcccagctacttgggaggctgagggaggagaatcacttgaacctgggaggcagaggttgcagtgagccgagatcgttccactgcactccagcctggtgacagagcaagactccgtctcacaaaaaaaaaaaaaaaaaaagatacaattagatcccattcttcacaccatacacacatgaataaactccatatggaatagagctctaaatataaaaaagctgtacaaatgccagaaaacatgggtaaatgcctctctggcctgagtatagaggaagctttctaatgatgactcatatgcaacaaaagactgatacattttcaaaaactgaagaaaaataaactacaaatcatacaggaaaacaggtaaaaagatgaacaaacaattcttttaaatggtccttaaacattcgacttgattcataatgagagaaagataaataagaactactgtaaaacaccacttctcacctgtcatattagcaaatgttcaaagcttgacaatacactgttgataaggctgtggaggaaacaggcactctcatacactgctgggaatgcaaactggcacagccccttttaaggggaatttgccaatatctatcaaaactacatatgcatttacccagaagtcctactttaggaatttataatgaagatacacctccaacaatataaaaaacatacatgcacagagtgactcattatagcattaattgtaactgcaaaatctggaaacctacataaatctccaagcacagaagactggttaaataaactggagcatatacacaacggagtactgaaaaaggacgaggagcgcttctgaattgatatggagcaatctgtatatcctaaagtcaaaaggtcaaagtgaaaaagagtaatatacatgctacgtttcgtgtaggaaagaaaacaggaaaacaagcacgtatgtgtttctctttatagcaacgataaaccagagaacaatgaggttcatcacctacaagggaggagtgtggagaatggagcagaagggatgggagaaagagagagactccgagtatatagcctttttaatagtttttactatacaaaatacataatattctacatattcaaagaataaaattaaacatcagtgaggatgggaaaggagaaaaactgctaaaacaaaacaaatcaacctatttgcatttcccatgaataccacaatcgcaggaagagaacaaaaaagaaatacagaagtaatccaggcaacttagaaacgtatttgactacgtaagtacattcagtctggggaaagctggaggcggggcagtgggaagaggtacaaataattcaactgttagcaggttttctgtagaggtatgaacaaagcgattctgaaacaactttagatgtattaagaacctgagtaaatgtgttgattttgttgggctcagggctctcctagagaaagggacataaaaataagcaagagaagaaggcgaaaatgaaccttgggatgaatttgcagtactggtgtgaacttatgatttctaaatcacatatatgtgcatgcatgtatattcaagcctgtatggctgtatgcatatatttgcatatatttcctgatttcctagttctgtttgctgaaagcccaaaaaacaaaacactccagtggtaatgagcacatctagtaccccattctgggtctactattaccattatttactaaaaggaaccagagctcctcaaagaaatggctgattgcaggctgaaagcaggaaacatacaagatgagcatcatgctataccagcaagtaaagagaggctcaaaaaaagggtagggacacgctgcaagacccagcttgaacatccagtgttcaagcaccgtaataactaagtatagtgatacattataaaccactgaagataggatttcatgagtctacacaggtacaaacaggggagaaagggaggcctcttgcttacagcagaatgtgagtgctggttgataaatgtagaaggaataccagaattggaaaagtcagcactctgcaactatcagagtaaagactggatcaggagagaatcatcagtgaattctacgtctaggaggaaattctgacaaggagcaggatatccgcatggtcttaaatatttataatgcttaaattatttacaagggggaaaaatacaagagtggagagacaatgccttggccaggtgttctaatttaacacctccagaggggcagatagacataatatgcttttagtagggagaaggacacatcacctatgagaatgcattacatgaactgaatcaccaggtaaacccaaaacgaacaatgttttctactaaaacagagggtggagagaagaggggggactgtatttttcaaatacatcattttcataaaagacaaagaagagctgtacaaatgttccagattaaagaaggctaaagagacttgaccactatattacattcctgaccttgactggatctgtagcggaggggaaaattgttatagaaaacaattacatcagctgaaaaagttggaaaatggatggtagactaggtaaaagcagtatcaacttccaatttactcaatttgaaaacttactgtagttatctatgagactatcccaatccttaggaaatatacgctgaagtatttagggataaagggccatgatgtatataattacctacaaatggtttagaaaaatacttgcatgtatgaaagagagagcaagaggacaaaatgaagtcaaatgttaactgcaggtaaatctgagtgatgggaatctttttactgttcgtattcttgaattttttctgtgcatttgaagttattaccaaacaaaaagtttttaaagtatcagaaagcaaatttgtttcctcttctacaccttcccctccaggtactgctttgccatcctactgcctgttgtatctggaaaaagtggtcttcacatcccactcctctcatgcctcatttcttccacgcagaccacactgcattagcgtcttcaggctgctgcttgccctccgcgctgctgcccctggatgtttctggcccctccttccaccttgagacattcctctcctggctccacatattcccctgggagccctcatggctcccagcactcccacacaccgtctcaggtcctcatctctgcccaggatccctctcaattacagagcctcatatccaccttgccacccacacttttgcctaaatcagaaatgggctacttcccttggccacatccaaaacagcccctaggaccgctgattctattgcctaagtagttctgaagctcccaccccatcccccacctccttcttactgctaaggccttagtttgagccttctaaattctcttctgcatgactgccatcgtttctagaccttcactcttatccctgcccaattctttctccaaccactgtgaagaatttttgtaaaatgcacacctagtcactgggcagtgccaagttctcccaggctacttactgtggcacctaaagccttctgcaccagccgcctgtgcaactgtcaaccctcactgccactccactcactgattctcagcctgatctgtcctcctttgtttctttgacaagtggattattcgttttcttcctgtcctctgggattccatgttagactggctgctgactggcctggtctgcctaaaatcacagacactttgccacttacctctctaacctaggtgaaggccaggggcctccctgttctggctctgcttaaacccctctgtttgggttggggcgcatgatgtcccgtcacctgatgtagttcatccaatcctcttcttgagtgaaatcaaaatggattaacataaacatgcatcttcaatgaaaatagatggcttgaaatgaaatctatgttaatcaatactaagatccatcaaaaacacaggcagaaaagcaccaagacagcactagagtaaatgctgctaaaacataaagacaatacaaagaatgtaacacataaggataattaagttatccttataaacaatactggagatgcattctagggtatcagttatttctgaggctaagtgttgcccaaggaacttaagactattgtctgcatcctgtttgttttccaggccccgggctattcctatccaaagacatggatatgacaaggccctgccatcaaggtgcctgcagactagtaggagagtctggtaggaaaataaccatatgataaaaatgacagaggcggccgggcatggtggttcacgcctgtaatcccagcactttgggaggctgaggcgggcagatcatgagatcaggagatcgagaccatcctggctaacaccgtgaaaccccatctctactaaaaatacaaaaaaatggccgggcatggtggtgggcgcctgtagctccagctactagggaggctgaggcaggagaatggcatgaacctgggaggcgagcctgcagtgagctgagatcgtgccactgcactccagcctgggtgacagagcaagactatgtctcaaaaaaaaaaaaaaaaaaaaaaaaaagcaaatacaggacatggagggtgggaaaggggggatggactacaggaatagcttcaggaagagaagagtgccaagggaagagcaggtacagaggaactggtgttcaccccccgaagacatctggggcaggcaaagggaaaatcagacaggtaggcaaagacaagggctgcaaccataaggagtccagacttgatcctcgggagcttcgggcaaaggagtagcaaacttggatatgcgttttggaaaaattacttattttattaaactggagttggcaaacattttctgtaagaaccaggtagcatatattttaggctttgtgggccacacagaactgctgagtactatttttgtttaagcattcctttaaaagtgtaaaaatcattcttagtttgtaggccatacaaaaacagtccacaagcccagcagtgtgcccacctctgttagataatatcaaggaatcagagctaatttaggctggtataataacggcattgtggctatgttagaacttttgttttttttttgttgtttttttgagactgagtcttgctctgttgcccaggctggagtgcaatggcacgtctcagcacactgcagcctccaccacccaggttcaagcgattctcctgcctcagcctcccgagtagctgggattacaggtatgtgccaccatgctcagctaatttttatatttttagtagagatggggttttgccatgttggcaggcctgtctccaacgcctgacctcaggggatccacccgtctcagcctcccaaagtgctgggattacaggcgtgaaccaccgcacccagaccttttttttttttttttaaattcagactgaagtctgcagtgaaatggcatggaatctggaatttaaaatatttcaatcaggaaaaactaaaaagggaaaagttaaacagcagaatcctgataattgctgaatccaagtgatgggtatatggaagttcataagaaaaaaactttaggccgggtacagtggctcacgcctataagcccagctctttcggaggccgaggcaggtgggtcacctgaggtcaggagtttgagaccagcctggccaacatggtgaaaccccatctctactaaaaaaaaaaaaaaaaattagctgggcatggtggtgggcacctgtaatcccagctacttgggaggctgaagcaggagaattgcctgaatccagaaggtggaggttgcagtaagctgagattgtgccattgcacttcagcctgggcaagaagagtgaaactctgtctcaaaaaaaaaaaaaaaaaaaaagaaaaaaagaaaagaaaaaaaagaaaaatattttaaaaagatcaggcaaggtgcagtggttcatgcctgtaatctcagcacattgggaggctgaggcagacagatcacttgaggctaggagttcaaaaccagcctggccaatgaggtgaatccatctctactaaaaatacaaaaattagccagatgtggtggtgcacacctgtagttccagctactcgacttgggaggctgaggcacaagaatcgcttgaacctgggaggcagaggttgcagtgagccaagatagcgccattgcactccagcctcggtgacagagcgagactctgtctcaaaaaaaaagaaagatcactcacactagttgcagtgggagaatggattgaggcaagacaggactgagtcctggagttccaggagtaagtcactataatccaatcaagactgatttggtagctaagtcatgtgtccctgatgacacaagtaaggaattacccccaaaacacaactcttccatataaagacccagaaactcctgaatttcttaaaagttctaaaggctgaatggacaagccctttctaaccagttttcaacacgcagcatgagtctaatagcctggttacatcagccaaaagcgtcagacatagaacgccacccactccttccaaactacatacgaccaacaacctctgggcactcttccgagcttcttgttcatgctttatcgccaaggcctagaaaagtgaatgcaaacagttaagaaccggccctacattcttgctgtctctgcctccgagactcaggagccacttttcaagagccgagacaactcgttagagaggagccgtggcctgctctggccgaaaaccccttcctattaacagactgcaactagcccggaacgactttcaatttgcagagtccaaccatattccacaagacaatctaccacctcaaggttcacgcgtggattctacaccttaaatccttggatactgtctttgatttggagatgagcaaagaaaggaaacaagacaagagaaagtgacaaaatgcttaccaacccagaacaaagagtacctaggaggggcaaaatgtacaaaggaaagatgggactaaggaacagagaagtgatatgcagatgagaagagaatatggtttgtgttctagctactgttgcatttgtcttatgaatattaggaatgtatatgattaacgtgagttggttctattgcttaaatatagaaataagaatgaaaggtgatttttccttaaagtaaaaaactgaaatagaacattctcatgccaagtagtggagaagagatttctagttgtcgtaggggaggaggtgagcaaaggcgatactaaaagggaggctgattttctgaatcaaacccggcagggactggcttggagtcattgacacaattagtctattaggctagtgtaacactaaatatagggacaagtctcagaagggaagaactacttacgtcttatttgttctttaaacactctacatcagtgattttgataacgacttgtcatatgtaacaatctgccaataactggttgagttaatgtaaaaaaataattttctaacggctgtttagtttcttctgtaaaaatccctaccctaatacactgtattgagtataccattgtttgaagtaacaacaaattggagacaacccaaatgcccccgaatagatctaaaaaaggacagaacatcgaaaacatccaaacaatggcccatccaatacttaccacagctctgtaaaacaaaacgaaacaaaacacaacttctgtgttctgacatgtagagaccagtaagataaagtgaaagaatcaaggagttagaaggatttctatcacctgtgtgaaaaaagggggaactaactagttatatttgccagtatttgcagaaattcggaaaagatacaaaggaacaaaagtggttacctaagagggtagggcctaggaagatacctaagcgggatgggaagaaatctttcactggtaactttttatatttttaatatcccagccatatgaatatattacatatttcatattattattttttttaagccttgagctttcacaaagaaatgctcctgctggccaactactttaaatgtcttagagcagcacacccagccctggcattccccagtgatcttttccgtcccacccctgggttcccgcaggctgtcccctgggtctaagaaactcttcgaccttcctctccctacctagttaactccttttctgcttgcaggaacacgcggcaggtcgcctcctccccggtgcacccgtctgtatgcaggtgcgcttccccagatgagggctaggacgcacctccggggtctctattcacacctgcagcgggagcttatcatcatcactcaccgaccaaaaaaaaaaaagaaaaaaaggtggtggggtggagcggaggggaagaaggtcgaatcagatcacccctagaggtctctctgccctcgcaatcactctcaagtcctagagtaccaaacttaactgcagagggagcacgaaatggtgggtattttgaagcgctaatttttagggatcccctcccatccaaaacagggatgaatagttgaggaacaccggagcggggccctggcccttctcggaacgttgagcagacctaacatgacgctggtccgttcaaacgtcgcagttgtggcccacacagagcccagtctgttccaggggcgcgccctgcacccctctgcctgcccgaggtcttccctcccctccgctccccagaaacgcacccactgagacatgtgcggggagggggcacgcttactcccacatcccgcccgagacccgcggagcagccaagacccggccaaaaaggggagggcgtggcaggcaagggccgggggcgggagcgcgggcggccgcggactcacgtactggctgtggcggcgccgcgggaacccggccgccagcgggacaaaagcgcggaccgcacggccggaagaacccgcgccggccctggggcacttccgcgccctctctgggacgctggaggactgactcgatggtccgggccgacggcgccggcgggagggagggaggggagcgcctcctcggctatttattgaggaccagctgcagggcgcgcgctccaggcgcggccaggaggccgtgggcggggctttctgtttccgtgcccattagcttctggggtaggctgggggaggggcacaggtaataaagtaaatacctgcctacctggttcctgaacacgtgattcattgccaggtgtgggtgcggggacgttcccggaagtgggggcctggcgggaaatgggggaatccgggaggggcgcaggacagcgctgggctggggacccattgccttctcagctggttgggggctggcccgagagcaccagcccttcctggtcgtcagcaccagaagcgcccccggttaggcactggggatgcggagtgggagcgcgcccctggagccgtccctgggaccgggccacgctcccacccggggcgccagcttggcagcgacctcgccccctgcccaccccaccgccggtgtcggcttccaaacccagggcctaaaatgactttgaagaccttttttttttttttaaattaatgtttgtgggtacatagtaggtgtccctatttgtcgagtacgtgagatatcttgatacagacaggaatgcaatgcgtaataatcatatcagggttaatggcgtgtccatcacttcaagcatttatcctttgtgttacaagcaatcaaattatattcttatttttaaatatacaactaagttattggctatagtcagccttttttaaaaacagcaacatctaaatatttttcatattaagtttaaataattgcaaagggtatatttttggcatgctgttaatattaagaacaaaattgctttcaagtgtatccaatggaatctaaatccctgaagatttggtattatccacttttaacagtcataagttttacatcttttagggtttttttccttgaacttttatgtccctcaccggctttttattctactgtaaaaatattttcattctatgtgcctcattgaattttatcctagtgtaaaatagttctatgcattgttttattgtttattgtttatcctagcatatatgtccgtaacgaaagtagattacattttttcttagtgttattttctggattattagcaaaattatataaatatttcaaaatgtttactgttaattcttagacaaaaagtgaagtgctttggaagcacaacttgtaatgagatggattttgttttacagctcaaattatttatattatttgaatgaattttacatattgctggggtgagccggtgtttggcatcagctcgacgcctatttttcatttttatacatgtgggtgctgagacactgtgttcactcaagtagagggaatgggcgtttcattgtagcaataagacccttgacggcatttgggcttcacgccacaaccccacccacctcgaagaacgtctgggcgagttagcaggcagcagcgactcctaaggaggagcagagccccaggcccaggtctgcagctttaggtgagagccccagagcgagcagaggattgggagttagagctgcccccaaaggatagtgagacacatgcagctgttgagcacttgaaatgtgggtagtgctgctgaggatctgaatttttaattacatttaatgtaaatagccacatgtggctaatggccaccttattggatagcacagctctagaaggagcttcaggtggtcctcacaggcctccagaattaaagctgcccttaaaggttcatggtaggcaaagactgggtttttacctctaggcagcaagatagaaaaatattcatatctgggttggaacacttcgctcaatgaaaggtggtgtgtgtgtggaagggattatgggaaacccacataaatcatcttgagtcagatgctttttattttatcttattatttatttgttttgagacaagctctcactttgttgcccaggctggagtcagggtggcatgattatggctccctgcagcctcgatctcccaggttcaagggatcctcccaccacagcctcccaagtagctgggactacaagtgcatgccacaacagccccactaatttttgtcttttttgtagagatggggcctcactatgttgcccaggctggccttgaactgctgggctcaagtgatccgtctgtcttggcctctgaaagtgttagaattcaggcgtgagccaccgtgcctgtcggatccttttgattttagatgacggcttttcctccttgagccttgttatattgcaggcacctttcatttggcctgtgtctacataacacacacagacaacagacacagacacagacacagacacatgcttgcctttctaacacttttagagatatctacacatcagagctgagttcagtagggcagtcattattcacatgtagcttatggtagtctgaattgagatgtgctgtaaatgtaaaatccacaccacatttctaagacttaggaaaagagaatgtaaactatcttattaataatttttaatgttgattacatgctgaaataatattttgactatattggggtagatcaaatacatggttgcaatgaattttacctgtttctttttactttaaatgcatctagaagatcagaagtcacatacatggctcacagtacatttccattgaacagcactgctctaggaggccaataggtgcagcagtgaggttgtctgggtttgctcttgctttgctggctcatctacctccctttggagtggtttaagtacaaattaatgttgagctaagcccatagggcttaattccaactctgtgtttagccattgaatttggtcacagatttatttttgttttttttagagacagcatcttgctctgtcacccaggatggagcgcagtggtgtgatcacatagctcactgcaacctcagtctcctgggctcaagcagtcctcctgcttcagcctcctgagtagctaggactataggtgtgaaccactagatccagattaaatatttttttttttttgtagatggagtctcactgtgtcctccaggctggagtacagtggcacgacctcgactcactgcaacctctgcttcccaggttcaagcgattctcctgtctcagcctcccacgtagctgggattataggcacatgccaccacaccaggctaatttttgtattttggtagagacaagatttcaccatgttggccaggctggtctcaaactcctgacctcaggtgatccgcccaccttggcctcccaaagtgctgggattacaggcgtgagccactgctcccggcctcagattaattttttaattttttttgcagcggtagggtcttgctgtgttgaccaggctggtctcaaattcctgggcctcaagtgatcctcccaccttggcttccaaaagtactgagattacaggtgtgaaccaccatgcccaatggcaaatttattttaaaataaaatctctcctcccactgtaccataatatcagttcattatgttaaatctggaaaacagaaaaattattcttaatttagtaaactagtttttggtcttgttgcccagactggaatgcagtggcacgatctcagttcactgcaacctccccctcccaggttcaagggattctcctgcctcagcctcctgagtagctgggattacaggcgcacaccaccatgcccagctaagtttttgtatttttagtagagatggggtttcatcatgttggccaggctggtctcaaactcctgaccttgggtgactcacctacctcggcctcccaaagtgctgggattacaggcgtgagccaccgcgcccggcctaaactttcctttttttaaaaaaaatagagacaaggtcttactatgttgcccaggctggtcttgaactactgagctcaaatgatccccctgcctcagcctcccaaagtgctgggattacaagcatgtgccaccacacccagcccataatttagtaaattttcttacttagtaaactttagtaaacttagtaaacttacttagtaaacttagtaaacttttttctatcaccagtttgtgagtgtttttcagatagtgtcataatcatactatatctgtatttttatatagcatttttacaaataatattatacattagcatttttcatgtttttactctctgtgatattccattaaactacagtctccttaactattctgtataactcacagaggttttttctaagtatgtcttttttaaaaaataaatcagtgctgttttagatagtagcgtgcagaacgctttcatcgtattttccttggaataattgacaagaagaggaatcactggttcaatagacagacatttttaagagtcttaaaataagaacaatagggaattagaaacactaataagcttaataggtaaacactggaaacaatcagagtaaagaactagacaaggttgttactcatcagtactattatttcccattgcagctggattaaacaaagaaaaaagaagtcagaatataaacattggaaagcagaggtgtaattgtcttatttgcagatatgatttcatttttggaaaactcacaagaattaacttgaaaaaactagaaaaaacgagaatgctgtaaggtgtgttttcaaaattaacatatagaaatcaagtttccttatatagaaactacagttggaataatggaaggaaagactacatttacaatagaaacaaacaaaagaccaaatgcccaggaattcatgactcacgtgcaagacccatatgaagaaaatttacagtgctcctggggacatagaggatgaactaaacttatggaaagattcttggatgttccattcacatgaatggaaacacttgacatcagaacagtcatttcttgtaaagtataattgtcatgatcctgataaaagctagcaatagaatctcctttggcaacccacaactgattctaaagttcacatggacaaatttaacagactcttgcttgtttctagctagaaaatgcctataaaaatatgaatgacgcaaggcactattaaggcacgttaataattaagctggtataattctgagacatacatataaagtctagaaatagacctaaacagtcatgggtattcggcatctggtaaagctagcatttcaaactagtggcaaagacagaacagggacagctgggaagcattggggaaaaaatgaagttggattcaaaccacagcccttacaccaggatgaatgccaggtgtatctaagactgaactgtgaaatgcacacacaccaaccatcctggcagctgctcccacttccataaaattttacaaagaaaaaaaaaaaactgcaggagattgctttgctcatattggactgagggagggtttttgttttctttctttcctttttactataacgcaaaatccaaaaactgtaaaagtaaagatagagcaattcaaacacatagaaataaaatacttccgtgtggcaaaaccactacaagaaaagtaaaaaaatcaaatgactaactgggaaaaaatatttgcatgttatatcacaaagggcaaatttccctgatacacagagcttctccaaaattgaaaacctgaacaacccagtggaaaaatgggctcacaggaaagcttatacaaatgattcaaaataaaaaagaatgcaagcccaaactacatggaaatacaatttttctcttattagaatggcaaagatcctgagtttgatccacgctgtggtggtgacagcatggtggggaaagcactcttccccgctggtggggtgttgacggacctcacctccagggaaggcagcgtgcggtgtggatggacgtgcacgtactctttgccgcagcaattctcctctacgagtctaccctgctggtatagtcacacactcatgaaatggtgtgtgaaaaggttattcacaatagtgtgtctaaagtaaaagatggagaaaacctaaaggtccaaactaaagacgtgattacataaattattgtacattcacgtgtattagttttccagggctgctgtaagaaagtaccccacacaatgtggcttaaataggaacaagttattgtctcacagttttggaggctagatgtctgagatcaaggtgtcagcaagtttggttccttctgaggctgtgagggagaatcggttccacgttttgtacctagctgctggtggtttgatggaaatccttggtgttcctttggacggagaccaccacttctcctgttgtccttcccagcttctccccaacctccccttttccctagtttataagacaggagaaaagggagaaagcacagagttggaaagaaacagaagatagcgagacgaccttggcgccaccacctggccctggtggttaaaataataataataataataataataataataataataataacccctgaccaaaactactggtgttatctgtaaactccagacattgtgtgagaaagcactgtaaaactttttgttctgttagctgatgtgtgtagcccccagtcacgttcctcacgcttacttgatctattatgaccctttcacgtgaaccccttagagttgtaagcccttaaaagggctaggaatttctttttcggggagctcggctcttaagacgtgagtctgccgatgctcccggccgaataaaaacctcttccttctttaatccggtgtctgaggagttttgtctgcgacttgtcctgctacacttggcttgtggacacagcacccagtctctgcctttaccatcacacacagccttctcactgcatgcatgcctgtgtgcaaatttctcccttttttaaggagaccagttatatcggattagggccctaaactactcactccagcatgacctcggcttaactaaatacatctgcaatgactctgtttccaaataaggtcacattaggaagtatctggggttaggacttcaacatacgaattttgggggaacacagttcaacccataacagcatgcaatgtactactttcagccataaaaaaggaagaggggcctctttataaaatggtatgggaaaatctccaagatgcatgtgaaataaagaaatcaatgtgccaagctatgttataatttgcataagaaagggtgaaatgaatgtgtacatatttgtgtatgttcataaaaatgttcctgaaagttcacaccagaaaccactaaccggggctgtcggtgaggaggcacctgggtggctggaagagaagggtgggaaggagaattttcagtgcatatcgtctttatactcctgcattttgaaccacgagaatatagtatttattcaaaaattatatgtaaacataaataatcctaaattgcatcagattgctaaactactacttcaagaaggagtatttcaatttataaagtttccaactataagtaaaagctctttactcactcacctccccaggattgggttgtggcaggtttgttttttctctaaatttgtaggcagcaaatagtgtctggttgtttaattttctttacccttctatcatgtgtgtcacccaattgagccatctctcccagggactgcctgtcctgtccttacatcaagtctttcggtaccttttgtagagtttgtgtccattgtgggaacacattctttattaaagaagttcaccttttgaattggccatcaattgctgttctctttcctgcttgccctttaacaccaacaatttcctttcatccctcaagctttacatggatgtgtaaaatctgtgtggcaggtggcgctgttgagctggaagggaccgtgggatgaatctggagaaacctgttaccagaggctcttaagggataacccacagtccctgggaaaaggtctagaaggagcaagcagcctcctactgttatcatttctgggtcctgtggaaagggagatgtctgtgtcaggagttctgactgacacttacatctaaaatgataatcaacaacagcgagaaattttatggggcttattttgtgccaagcactcttctaaatgctttatatatatagatacattgaatcttctcaacagccctttgatgaaggcactgtgtgtgtgtgtgtgtgtgtgtgtatatatatatatatatatatatatatatatatatatatatgcacatacatatacctgttctacagaaggggaaacagagagggaaagcaaattgtcccaggacacacagctggtagttttgaggctgtgatctttgacatctttgaaatgctctggcctgggcacctgctggttcaagcccagctgcttgttctcctcctgtagatatattcatctctggttgttgttcacaagccacagagtgccaagaccaaacaggaggctgttaggacaccacccttacaagcctctgccaacttggcaggaggaggaaatttttgttttaaaagaaagagaactggatgtcctcttgtacacatggattaactcacagtttcataagaccttgggaaaggagaaaatcaaaggagctgtctttccctaatttggacggagagttggtgaaaaatggcacctgctccaaggtattttcttgaatctgtgttgggctctgggtttcttatgggactgggcagttgtgtaatctttggtctctgctccctcatctggaatataggtaataataatacctacttcacagagttgtgaaaattaaattagcatatgtaaggcacttagaacatacatattgatatattgaatcttgtcaataacccattgatgacagcactgcatacatccccattttacagatgggggaacagagagggtaagaaaactgtcccaggactcacagctgggcagtcttgaggctcagatcttatgacgccatacagtatgcactatctgagttttcatgattggtgttgctgtggtcacactcccggaggtaccgtgtcttcctgaggggagtggatcacctttctctatctccctgggaagcggaagatgttggggcgggatctgaggacttgaaaagtgcagccttagctgggtcagtggttgacccctccctctctctgggtctggctgtgtcggagtccagagaaacactgagggagcaggtcaggagctggcagggagtgccccgtaggggccccacgggactgcccagggtctgtgggtgtggaaggtagcctgtggcaggttattctccgaacaatagctcttctgaagcatgatggtctggttgtgactggactaagggaaaattacaagaaaggcttacgttcatatctgcctgtgtggtgcgcaccagggtcccgagtacaaagcactgttactaaactggaggtgacagcagtgtagacacacacaatctggactggccctggaggacacatggaatacctcaaagacccagcaatgctagaaaagcgcaatggtgtagtcagcatagttagacgaggttgcagtaacaaatacaccctccctcccggtggcctaagacaagaaggtttatttgttcttcacgtaaacttcattgtaagtcagtttgctctcttctgtcttgcagccataatatctggaatgtgtggccttcagaattgccactgtagagaagagaaggctggaagaccccatgggatgctttaagggctaggcccagaagtgcaattacgtcatttacaaccacctctctttggccagaaccaggtcacacagctccgttctaactgcaaaggaggccagggcttagaagatctcgtggatatttggtgaatactggcagtcttgccatagtcaggaaacttcaaaaaggggaaaagatgccctatggccacactccactctggcccacaagctggcatcatccaatgacgtggccgatgtggcctcatttgttgcgtgggctggcaaaacccatattcaggttatacaggaatccttcattaaagtttagaggtcctttctcctccaaggcccagttctgttttttttaaaattaattttaaaatatttttccctttgatcttttaattaatgaactattaccatataacaaattgcccccaaaactcggtggcttaaaacaacaaacatttattatttcacagtttatgtgggccaggaatttgaatgcatattaactgagtggctctgattcaaggtctttgacgaggctgtactgaaggtgtggactggggttgcagtcatttggagaaatagcccagttggagttggaggatttgcttccaaattggctcgttcccgtggctgctggtgggaggcctcagtttctcatagtacaggtccctccacaggcctgcttgagtgtcctcatggcatgacaagtgatccaagagagagggtgacactggaccatggcgctttttatgccctggtctctgaaggtgcacaccgtcgcttttgccgtatgttactccagtagaagcaaatcactaagtccatcccacactcaaggaaaggacctaaactccaactcttcaaagcaggaatataaaagaatttctggaaatattttcaaactacaacagtctcccttgaatttattttggaacatgagtttccattccctacgaagaactgattgccccattaccatttactcatttaacttccccattgaactaatttatcgtattaaatcattatctagaaaagggcttgtcatgggccacctatttagttacattgacctgtctggctattgtcatgtccaagtacatttaaatttttcagaggtcataaaactttaagccagaccacaagctccctagtagcacagcctgtagacatataagggattatactatgttgtattaagtgcagggtcttagcacactatgaagtgtacatatgaagttgtactgcccttgagggcagtagcaactcgactgacagaggctctgcccgaagccaggcagtgatcatgctgaaggtcaggccaacgagggtgtgtgtgtgtgtgtgtgtgtgtgtggtgggagtgggagggtgctggggtaccaagaatggcagctgaactgcatcttttgttagagatccgaaactctcagcttgcgggactttacttcacaggcgtaagcacaatctgatggaaaatttgaatcctgaaaacgtgatatttcatctgtatctcatagacatggcacctggcaccgtcccagacagggcacatcatggggcacttggttagtggatgggttgtcaggtcagggaggcgacacaggatcacctgagcacatccaggacacctgccaggaccagccgtgtgaggctttcgactgtggcgggggcacctgctgtgctgaatggctggtttgtctctgggatttgggtagaaaacagagccaccaaggtggatgctcagtttcaagacctccaccctccactgggggaagtttcaattcagctgtggccatggggtccacagcaagacaccctcccaccccatgagacacagaaagaggaagaaggctgctatacgggaattaaaatataaagctccaggcataatacagagaatcagctcctgataaagtaagccaagagactgtctctacacacgtgactgagttatgctcgtcccagatccaaagctgaaagagcaggactggttcgggatttccatttgtcacctgtggctgatgctattgtctagctccccggtagccatccccacttctcttctgtttgactaacagagccccagaatttttccaagcagcaacacgcccagaccaatcagaattgatgtaagatgaacaagcacagcgactcccattctcctttcccagatactcaatttccctgcttgcagctaaaggaggccaggtgacctgtgtggccactgagatgtgtggggaactctgatatgagctttgggaaagattttaagattaaaaaagaaaaccaggcctggcatggtggcttactttgggaggccaaagcaggaggatctcttcagctcaggaattcaagaccagcctgggcaacatggtgaaaccccttctctaccaaaaatatcaaaaaaaaaaaaaaaaaatagccaagcatggtggcaagtgcccgtggtcccaaatactcgggaagttgaggtggaagaatcacttgagcctgggaggtgaaggttgcagtgagccgagactgcaccactgcactccagcctgggtgacagaatcagaccctgtctctcaaaacaaaagcaaaacaaacaaaacagcacagagaagaactggctggtactgcctcttcctgcgtcctcctatgtgatgcctgggcctcctccagtcttgtcaccatgaagccacacccaggaggccctaaaggcggctggctgatgagggcggagtaggagacgggtgtgacggttaatttggtgtcaacctgatgggccagatctttgggcaacatcttctggtgtttctgtggggtgttttgcatgagactggggggactgaggaaatcagattgttgctcctaatgtgggtgggcctcatccattcagacgaaggtctgaaaagaacacaaaggttgatctgccaagcaagagggaactccccctgcctagcagccttcaaacgagggcattggctatttcactcagcccgcagacaggaactaaaccatctgctctcctggatctccagcttgctgactcaccctgtagatcttgaggcttgctgcttttataattgcgtgagccagttccttaaataagtcagtctctatctctgcatctacttggttctctttcgccagagaatcctgactaatacatggtgtcagcctaggtcttcactgaccccactggtctggttcaccagcactgacctgcctgaactcctggcctcaagcgatcctccagcttcagcctcccgagtagctgggactacagactgaaattctaaggaagcaggtagatccccaaacaaactgttttttcctgaaaacaggaaagtcacaccaaccagttggaaagacctcagtttacctgagtcagcataatgaagaagtcccctctgctttaacttacaagaaaataacctgaagtaacctgatattaagcaatctgatttttttctattgttctgtttcctcgttcccaccttacaaagcccacagttctgctattgcccagtgggagctctccttctattttgaagaatagaggcttccctcattcataaaagccaattagatcttaaaaacaaatttgtgtaattttgtcttttgacagtacctaagagtgtatctgccataaacttctcaaggaattatgtgagcttctgagaaacaatagcttgctgaaaacagggaggcagcgagcatgagagtaatgtggaaaaatctcacgtggaaagaaagaatgggataaaaagctggatatgctgtaaacaaggtatctatttacaaagacacacagaaacttctgaacctttggacaaaaaagcgacgaagaaatttgtcaaagtgttgagcagttgcttctagttggtaggatttaaatattttagtctgtttgctttttatatcttttataaacaaagccctcttcactcctgtgtggctggcacaggagaacctatgtggacttaacaccctcttcgtatgcctcctttcccaccctccatttcgtctgtctacgaattcagcttcccaggaaccaaggaaagcagaagggagatgcctgtctacgtggagagttcagtcatgatacacaggattaccggctgtgactgactgagccagcatatgtgttgagcagtcagctgtgagtctgggtagcgtgagtctggtaaggcagacagacggaatttctgccttcttgtggcagagtcccttggcggggctggcaggactcagaaacaggggaaggcacatgccaacatccccactaactaactgaggccagcctctgctaggagcctcctgtgtcaagtgtggggcttaccacattatagctatctcactcaatccccaggacagcactgtgaggccagtgctgttggcagaaaggctgggaggtacagagcaggggagtccacatgtggctgtgatgaccaggagcccctcactaacagcagaggtgtggactggggtgaaaaacaaagacaaaacgtccacaggagtgttaacactacagaaataaaaagtgttagaagaggccgggtgtggtggctcacacctttaatcccagcactttgggaggccgaggcaggcagatcacctgaggtcaggagtttgagaccagcctgaccaacgtggagaaacccagtctctactaaaaaaaatacaaaaattagccaggtgtggtggcgcaggcctgtaatcccagctactcgggaggctgaggcaggagaattgcttgaacccaggaggtggaggttgtagtgagccgagactgcgccactgcactctagcctgggcaacacgagcaaaactcgtgcaaaaaaaaaaaaaaagaagaaaaaagtgttgggaggatggacagaagcatctggggaagactttgcaggtgaaaacggcagaactctcactacatgacaactttggtcaagctctgagagactttaccaaactctagcatggcttctaacagcgtaaggccatgtccctcagataaaaccagcgttccttcaagtgcctgcctgagaaagttcaatgtgccagggaatgactatttgtcttagctaacattcatctggtgataggcccttggactcccttactataaaaggcttacaattttaaatacagtcgtgcatcatgtaatggcaggaatacgttctgagaaatgtgttgtgagatgatttcatcattgtgtgaacatcatagagcgcgcttacacaaaccgagatggcacagccggctacacacccaggctgtatgacacagcctgttggtcctgggcggcaaacctgtactggggctaaaaacctgtacagcatgtgactgcactgaatactgtaggcaactgtgatatgatggtgagtatttgtgtatctaaacatatccaaacatagaaaagacacagtaaaaatatgatataaatgattaacaaatggtacaccaatatagggcatttaccataaatggagctgtggctactggctggtacagtattaggtgtacctgaagtatttgctgatgcctgcctctctgcctctgaggtttttctggaacaaacgccactgtagtcagctggcagtgatgaagcccagacattcagtaaattttaaaggggtatgggatcttgcctgccactggagcaggtcaggaggctcaaactatggctactgacctggattaagaggctttgggggtaagcctcatgcttggttttattgttgggggccaaatgttagggaacaaggcagaatcctatgttcacttccatctctcctccaagtggatggtatctctctctgtgctatgatacctgcagttgggggagaagtgattcaggtaattaaaactgtcctttctaccctctccaatgcatcttttcttattatgttacaaccatatactctgatctctcacctggtctccttagctctcatgaaggtatttatgtatgttgctagtcattctatgtgatgtttctgcagtgagacaacagctaaagagttctcttctgccatcttgctctgtccttcatcctactctatgtttcttcaaagataaattatgtgtatttgaggtttacaacatggcattatgggatgcatatagatagtaaagtggtactccagtgaagcagattaacatatttatcatttcagatagttactttgtatttttgtaataagaggagctaaaatatgcttatttaacaagaattcctaatacaatacaatttaactacttgacttcttatattgtacattagacctctagatattgattctacatatcgcctactttttatcctttgatctacatctccgcatttccttcgcctccctcagccatgataaccagttggttctctttttctgtgtttttgagattaaataagatcatgtaatgtttttctttttttaatttttaatggattttattggtgacgctagtgacttgctaattagcatgatgaatactggaaattggctctttttttgaatagagtcacactctgttgctcaggctggagtgtggtggcatgatcacagctcattgtaacaaactgggttcaaacaatcctcctgcctcctcttcctgagtagctatgactacatgatgttatgggactacaggcatgtgccactgcacctggctaattaaaaaaaattttttttttctagagacagggtcttgctatattgcccaggctggtcttgaactcctggcctcaagcagttctcttgcatcagactcccaaagtcctggaactacaggcctgagcccctgcacccagtcacattttcctttctgtgtctggattattcagttagcgtaatgtcctccaggtccatacatgttgtaacaagtggcaggatcttcttttctaaggtggaaaaatattccattatgtacatatatcatatttatgtacttgtctttctatggcatttacattgtttctatattttgacttttgtgaataatgctgcaataaacataagagtgcaaatatctttacaaggtggtaaagaagagggactgctgggtgatatggtgtattaatccattctcacgctgctaataaagacatagccgagactgggtaatttataaaggaaagaggtttaattgactcgtagttccacagggctggggaggcctcaggaaacttacaatcatggcagaaggggaagcaaacacatccttctttacatggcggcagcaaggagaagtgccaagcaaaagggggaaaagcccctttataaaaccatcagatcttgtgaaaatttacttactatcaggaaaacagcagcatgggggtaaccactcccatgattcaattacctcccaccaggtccctaccacgacatgtggggattacaggaactacagttcaagataagatttgggtggggacatagccaaaccatatcatatggcatttccatttttaattttttaggaaactttatttatttatttatttagataggatctcattctgtcacccaggctggagtgcagtggcatgatttcagctcactgcaacctctgcctcccaggctcaaacgatcctcccacctcagcctcccaagtagctgggaccacaggcatgcaccaccacacccagctaattttctgtatttttggtagagatggggttttgccatgttgcccaggctggtctctaactcctgagctcaagtgatccacctgcctcggcttcccaaagtgccaggattacaggtgtgagccactgtgcccagccaggaacctttataatgttttccataatggctgtatcaacctacactcccaccaaatattgtgcaggggttccctgttctccatacccttgccaacatttgttatcttttgtcctttaggtcctagctattctaatatgggtgaggtgatatctcgtagtggttctgatttgcatttgccttatgattagcgatgttgatcacatttttatatacctgttggccatttttgtgtggcttctttggtgaaatgtctattccagtcctttgcccatttttaattgggttatttttctgctattgtgttttaattgttctttataaattttaccctttatcagatatgtggttgcaattgttttctcaaagtttgtaggttgtcttttctctttgttgattgtttccttcggtgtgcagaagcattttagtttgaggtggtaccatttatatatttttattattgtgcttgagtttttgaggtgatacccaaattattgtcaaggccaacgttgaggagctttccctctgtgttctcttctaggagttgtatggtgtcaggttttatacttatgtcttttatccattttgggttgatttttgagcatggcataagataagaatctaattgtattcctttgcatgtgtaaatccagttttcccagcaccatttattggagagactatctgttcctcattgtgtcctcttgtgccattgtcaaaaattagttgaccatagatgtttggatttatttgtgggctctcttctctgttccactggtctgcatgtctttttttataccagcacaatactgtttttattactctagctttataatacaattttaaattaggaagtgtaaagccatcagctttgtttgtctttctcagtattgcttttgctatttgggttattttggctccatataggttttagaattgttttttctatttccataaacaatgccattggaagtttgatagagattgcattaaatctgtatattgctttgagtagtgtggacattttaccaatattaattcttcccattcatcaacacagaatatctttcaattcatttttgtcttcttcaatttccttcatcaatgttttaaaaatttctgaagactaatctttcatcaccttgttaaatttatccccttgttaaatttattcctaggtattttttgatgctatcgtaataggattttttcttaatttctttttcaaatacttgtttgttagtctatataattgccactgatttttatatgttaattgtgtatcctaaaactctactgaattcatttattagctctactttttttgtgtgtataatctttgcaattttctacacataggatcatgctatctgcaaatagagatagtttcacatcttttttatttggatgccttttatttctttttcttgtttgattggtcttgctaatatttctagtgctattctgaataaaattggtgagagtggacatttatgtcttgttctggatcatagaggaaaagcttttagttttaccccattgattacagtgttagctgtgggcttttttataaatgacatttattaagtagaggaattttagttttttctattattatactttaagttctagggtacatgtgtacaacgtgcaggtttattacataggtatacacatgccatgttggtttgctgcacccatcaactcgtcatttacattaggtatttctcctaatgctatccctctccgagccccccccacccccgacaggccccattgtgtgatgttcccctccccgtgtccatgtgttctcattgttcaactcccacctatgagtgagaacatgcagtgtttggttttctgtccttgtgatagtttgcttagaatgatggtttccagcttcatccatgtcccagcaaaggacttgaactcatccttttttatggctgcataatattccatgatgtatatgtgccacattttcttaatccagtctatcattgatggacatttgggtgtgttccaagtctttgctactgtgaatagtgccacagtaaacataagtgtgcatgtgtctttatagtagaatgatttataatcctttgagtatatacccagtaatgggatcactgggtcaaagggtatttctagttctagatccttgaggaatcaccacactgtcttccacaatggttgaactaatttacactcccaccaacagtgtaaaagcattcctatttctccacatcctctccagcatctgttgtttcctgactttttaatgatcgccatcctaactggcatgagatggtatctcattgtggttttgatttgcatttctctgatgaccagtcatgatgagcattttttcatatgtctgttggctgcataaatgtcatcttttgagaagcgtctgttcatatcctttgcccacgttttgatgggttttttttcttgtaaatttgtttaagttctttgtagattctggatattatccctttgtcagatggatagattgcaaaaattttctcccattctgtaggttgcctgttcactctgatgatagtttcttttgctatgcagaagctctttagtttaattagatcccatttgtcaattctggcttttgttgcccttgcttttggtgttttagtcatgaagtctttgcccatgcttatgtcctgaatggtattgcctaggttttcttctagggtttttatggtgttaggtcttacatttaagactttactccatcttgagttaatttttgtatacagtgtaaggaagggatccagtttcagctttctacatatgactagccagttttcccagcaccatttattaaatagggaatcctttaagcattgcttgtttttgtcaggtttgtcaaagatcagatggttgtaaatgtgtggtattatttctgaggcctctgttctgttccattggtctatatgtctgtttcggaaccagtaccatgctgttttggttactgtaggcttgtagtatagtttgaagtcaggtagcgtgatgcctccagctttgttctttttgcttaggattgtcttggctgtgcgggctcttttttagttccatatgaactttaaagtagttttttccaattctgtgaagaaagtcagtggtagcttgatggggatagcattgaatctataaattaccttgggcagtatggccattttcatgatattgactcttcctattcatgagcatggaatgttcttccatttgtttgtgtcctcttttatttcgttgagcagtggtttgtagttctgcttgaagaggtccttcacatcccttgtaagttagattcctaggtattttattctctttgtagtaattgtgaatgtgaggtcactcgtgatttggctctctgtttgtctattattggtgtataggaatgcttgtgatttttgcacattgattttgtatcctgagactttgctgaagttgcttatcagcttaaggagatttggggctgagatgatggggttttctaaatatacaatcatgttacctgcaaacagggacaatttgacttcctcttttcctaattgtatacccttcatttctttctcttggctgattgcccaggccaggacttccaacactatgttgaataggagtggtgagagaggacatccttgcttgtgctgcttttcaaaggcaatgcttccagtttttgcccattcagtatggtattggctgtgggtttgccataaatacctcttattattttgagatacgttccatcaatacctagtttattgagagtatttagcatgaagggctgttgaattttgttgaaggccttttctgcatctattgagataatcatgtggtttttgtctttggttctgtttatgtgatggattacgtttattgatttgcatatgttgaaccaggcttgtatcccagggatgaagccaacatgattgtggtggacaaagtttttgatgtgctgctggatttggtttgccagtgttttcttgaggattttcacatcgatgttcatcagggatattggtctaaaattctcttttttgttgtttctctgccaggctttggtatcagcatgatactggcctcataaaatgagttagggaggattccctctttttctattctttggaatagtttcagaaggaatggtatcagctcctctttgtacctctggtagaattcggctctgaatccgtctggtcctgggctttttttggttggtaagctattaattactgcctgaatttcaggacctgttattggtctattcagagattcaacttcttcctggtttagtcttgggagggtgtatgtggaatttatccatttcttctagattttctagtttattcgtgtagaggtgtttctagtattctctgatcgtagtttgtatttctgtgggatcggtggtgatatcccctttatcattttttattgcatctatttgattcttctctcttttctcctttattagtcttgctagtggtctatgtattttgttgatcttttaaaaaaaaccagctcctggatttattgattttttgaagggttttttgtgtctctgtctccttcagttctgctctgatcttagttatttcttgtcttctgctagcttttgaatttgcttgctcttgcttctctagttcttttaactgtgatgttagggtgtcaattttagatctttcctgctttctcttgtgggcatttagtgctataaatttccctctacacactgctttgaatgtgtcctagagattctggtatgttgtgtctttgttctcattggtttcaaagaaaatctttatttctgcctttatttcatacccggtagtcattcaggagcaggttgttcaatttccatgtatttatgtggttttgagtgagtttcttaatcctgagttctaatttgattggactgtggtctgagagactgtttgttatgatttctgttcttttacatttgctgaggagtgtttttacttccaattatgtggtcaattttagaataagtacaatgtggtgctgagaagaatgtatattctgttgatctggggtggagagttctgtagatgtctattaggtcagcttggtccagagctctgttcaagtcctggatatacttgttaaccttctgtctcattgatctacctaatattgacagtggggtgttaaagtctcccattattattgtgtgggagtctaagtctctttgtaggtctctaaggacttgctctaagaatctgggtgcttctgtattgggtgcatatatatttagcatagttagctcttcttgttgaattgatccctttaccattatgtggtggccttctttgtctcttttgatctttgttggtttaaagtctgttttatcagagactaggattgcaacctctgcttttctttttgctttccatttgcttggtagatcttcctccatccctttattttgagcgtatgtgcgtctttgcacgtgagatgggtctcctgaatacagcacacagatgggtcttgactctttatccaatttgccagtctgtgtcttttaattggggcatttagcccatttacatttaaggtcagtattgttatgtttgaatgtgatcctgtcattatgatgttagctggttattttgcctgttaattgatgcagtttcttcatagtgtcaatggtctttacaatttggcatgtttttgcagtggctggtaccagttgttcctttccatttccatgtttagtgcttccttcaggagctcttgtaaggcaggcctggtggtgacaaaatctctcagcatttgcttgtctgtaaaggattttatttctccttcacttatgaagcttagtttggctggatatgaaattctgggttgaaaattcttttctttcagaatgttgaatattgacccccactctcttctggcttgtagagtttctgccaagtgatccactgttagtctgatgggcttccctttgagggtaacccgacctttctccctggctgcccttaacattttttcctacatttcaaccttggtgaatctgacaattatgtgtcttgggattgctcttctcaaggagtatctttatggtattctctgtatttcctgaatttgaatgttggcctgtcttgctaggttggggaagttctcctgcataatattctgaagagtgttttccaacttggttccattccccccgtcactttcaggtacaccaatcaaatgtatatttggtcttttcacatagtcccatatttcttggaggctttgtttgtttcttttcactcttttttctctgatcttgtcttcttgctttatttcattaatttgattttcaatcactgatatgctttcttccacttgatcaaatcggctactgaagcttgtgcatgcgtcacaaagttctcatgctgtgtatttcagctccatcaggtcatttaaggtcttctctacactggttattctagttagccatttgtctaaccttttttcaaggtttttagcttccttgtgatgggttagagcatgctcctttagctcggaggagtttgttattactgaccttctgaagcctacttctgtcaattcatcaaactcattctccatccagttttgttcccttgctggtgaggagctgtgatcctttggaggagaagagacgctctggtttttggaattttccacttttctgttctggtttctctccatcttgtggttttatctacctttggtctttgatgttggtgacctacagatggggttttggtgtggatgtcctttttgttgatgttgaagctattcctttctgtttgttagttttccttctaacggtcaggcccctcagcttcaggtctgtttggagtttgctggaggtccactccacaccctgtttgcctgggtatcaccagtggaggctgcaaaacagcaaatattgctgcctgatccttcctctggaagcttcatcccagaggggcacccacctatttgaggtgtctgttggcctctactgggaggtgtctcccagtcaggctacacgggggtcagggacccacccgaagaggcagtctgtccgttcttggagctcaaatgccatgctaagagaaccactgctctcttcagagctgtcagacagggacgtttaagtctgtagaagctgcctactgacttttgttctactatgccctgccctcagaggtggaatctagagaggcagtaggccttgctgagctgcagtgggctccgcccagttcaaggttcctggctgctttgtttacacagtgagccactcaagcctcagcaatggtggacactcctccccctgtcaagctgcagcatcgcaggttgatctcagactgccgtgctggcagcgagcaaggctctgtgagcatgggacccagcaagccaggcacaggagggtatctcctggtttgccagttgctaagaccgtgggagaagtgcagtatttggctaggagtgtactgtttctccaggtatagtctgtcatggcttcccttggctaggaaagggaaatcccctgccccttgtgcttcccaggtgaggtgatgccctgccctacttcagcttgccctccatgggctgcacccactgtccaaccagtcccagtgagatgagccaggtacctcagttggaaatgcagaaatcactcatcttctgcattgatctcgctgggagctgcagaccggagttgttcctatttggccatcttagaagcgacccacaatatctagttttttttgagatagagtctcactctgtcacccaggctagagtgcagtggcgcaatcttggctcactgcaacctctgcctccagggttcaagtgattctcctgcctcagcctcccgagtagctgggattacaggtgtgtgccaccacgcccagttaatttttgtatttttagtagagatggggtttcaacatgttggtcaggctcatctcgaattcctgacctcatgatctgcccgcctcggccttgcaaagtgctgggattacaggcgtgagccactgctcccggccagaattttacttttatacatgaattgttaagagttttttgttcgttttgagaaggaatctcactctgtcacccaggctgcagtgcagtggtgcaatcttggctcactacagcccctgcctcctgggttcaagtgactctcctgtctcagcctcctgagtagctgggactacaggcacacaccattacctctggctaatttttgtattttcagtagagacgggatttcaccttgttggccaggctggtctcgaactcctgacctcaagtgatctacccacttcggcctcccaaagtgctgggtttacaggtgtgagccactgcacctgaccattaagagttttttaaatcaagaatggacgtggaattttgtcaaatacttttctgtgtcaattgagataatcatgtggttttctgtttttcgtgctgtaaatgtgatgtattacattgattgagtatgttaaccagcctttcatgccaaggataaatcccacttggtgatgacgtatactgtttttgatgtgtttgatgaatttggtttgctaatatttgactgaggagttttgcattatatgagttattggcctatagtttttttttttttttttggcctaaagacacctattgtggtgtctttttcttgcttagttgtgaaagtgatgctggccttgtaaagtatgttgtaagtattctcccagctctattttctgggacagttaagtggtaataattcttctttgaatgtttggtaaaattcagccataaagccatctggtcccaagctttatttctgttggaaggtttctaattacttcttcagtgtctttatttattattataatagtttgttcaagctttctatttcttcctaatttattcttaaaagttactgttttatagtagtttattaacttttataagttgtgccatttgttggcagatgctttttcataattgtttattatgatgttttttatttttgaggcatgtattgtatggtcttcatttatatttctgattttatttattccagtcttttttttttcttagtctatcttggaatttgatattatttatttttcaaggctgggcacagtggctcatgcatgtaatcccagcactttgggaggccgaggcagcggatcacccgagaggtcaggagttcgagactggcttggccaacatggtgaaaccctgtctctactaaaaatacaaaaaaattttctaggcatggtggtgcacgcctatagtcccagctacttgggaagtggaggcaggagaattgcttgaacccaggaggcagaggttgcagtgagctgagatcatgccactgcactccagcctgggcaacagagcaagactctgtctcaaaaaaaattatttttcaaagaatcaagtcttggttttattagtttttttcacatggtttttctgttctctatttgatttatttctgctctgatattattgttcccttccttcagttaactttgggtttaggtttctctttttctagctccttagggcataacattaaattttttgattaaggtatttcttcttttttaatgtaggcatttatacctataaagttcccctttagaaccacttttgctacaccccatgggttttgatatattgtatttttattgtcattcatatcaaaatttaaaaaattccttctgtatatgtgctactgaagtgagcacttttaatttacctttgattcttatttgatccattgatttttcagaaacatgctgtttaatttccacatatctgtgacttttccaaaatttctcctgttactgatttctaattttatactgtcatggctgaaaacaataccattatgattttaatcttcttgagtttgctaagacttgttttatggcttcatatttggtttatcctggataatgttccatgtacactaggaaaaatacacattcttctgtctgtacatatctgtttaagtccatttgctctaatgtacagttcaaatccagtattttcttgttaattttctgtctggttcatgtatctatttttaaaaaggggtattgaaccagagaacaccacaaagatactcctcaagaagagcaaccccaagatacataatcatgattcaccaaggttgaaatgaaggaaaaaatgttaagggcagccagagagaaagatcaggttacccacaaagggaagcccatcagactaacagcggatctgtctacagaaatcctataagccagaagagagtgggggccaatattcaacattcttaaagaaaagaattttcaacccagaatttcatatccagccaaactaagcttcataagcaaaggagaaataaaatcctttacagacaagcaaatgctgagagattttgtcaccaccaggcttcccttacaagagatcctgaaggaagcactaaataggtaaaggaaaaaccagtatcagccactgcaaaaacataccaaattgtaaagaccatcgacactgtgaagaaactgcctcaactaatgggcaaaataaccagctagccccagtcagtgactggcaagatggccgagtaggaacagctccattctgcagctcctagcaagatcaatgcagaaggcaggcgatttccaactgaggtacccggcttatctcagtgggactgattagacagtgggtgcagttggtggagggtgagtggaagcagggtggggcattgcctcaccgaggaagtgcaagaagttggggaacttcctcccttactcaaaggaaaccatgagggactgtgctgtgaggaacggtgcactctggcccagatactacacttttcccaaggtctttgcaacgcacaaaccaggagattccctgggtgcctacgccaccagggcccagggtttcaagcacaaaacttggcaggtgtttgggcacacactgagctagctgtaagagttttttttttcataccccagtggtacctggaatgccagtgagacagaaccattcactctcctggaaagggggctgaagccagggagccaagtggtctagctcagtggatcccacgcccatggagcccagcaagctaagacccactggcttgaaattctcgctgccagcacagcagtctgaagttgacctgggatgatagagcttggttgggggagagttgtctgccattactgaggcttcagtaggcggttttcccttcagtgtaaacaaagccaccaggaagttcaagctgggcaaagcccaccgcagctcagcaaagcggctgtggcccgactccctctctagagtcctcgtctctgggaaggggatctctgaaagaaaggcagcagtaccagtcagggacttatagataaaactcccatctcactgggacagagcacctgggggaaggggaggctgtgggcacagcttcagcagacttaaacagccctgcatgccagctctgaagagagcagcggatctcccagcacagtgttcgagttctgctaagggacagactgcccttcaactgggtgcctgacccctgtgccttctgattgggagacacctcccagcaggggtcaacagacacctcatacaggagagctctggctggcatatggcgggtgcccctctgggacgaaccttacagaggaaggagcaggcagcaatctttgctgttctgcagcctccacttgtgatccccaggcaaacagggcctagagtggacctccagcaaatttcagcagacctgcagcagaggagcctgactgtcagaaggaaaactaacaaacagaaaggaatagcatcaacatcaacaaaaaggacatccacacagaaccccatctgaaggtcaccaacatcaaagactaaaggtagataaatccacgaacatgaggaaaaaccagtgcaaaaaggctaaaaattccaaaacccagaatgcctcttctcctccaaagcatcacaactcctcgccagcaagggaacaaaactggatggagaatgagtttgacgaattgacagaagtaggcttcagaaggtgggtaataacaaactcttccaagctaaaggagcatgttctaacccaatgtaaggaagctaaaaaccttgaaaaaaggttagacgatggctaattagaacaaccagtttagtgaggaacataaaggacccaatggagctgaaaaacacagcacgagaacttcatgaagcatacacaagtctcaatagccaaatcgatcaagtggaagaaaggatatcagagattgaagatcagcttaatgaaataaagcatgaagaccagattagagaaaaaagaatgaaaagaaatgaacaaagtctccaagaaatatgggactatgtggaaaaaccaaacctacgtttgattggtgtacctgaaagtgacagggggaatggaaccaagttggaaaacactcttcagcatattatccaggagaacttccccaacctagcaagacaggccaacattcaaattcaggaaatacagagaacaccacaaagatactcctcgagaagagcaatcccaagacacacaatattcagattcaccaaggttgaaatgtaggaaaaaatgttaagggcagccagggagaaaggttgggttacccatgaagagaagcccatgagactaacagtggatcactcggcagaaactctataagccagaagagagtgggggtcaatattcaacattctgaaagaaaagaattttcaagcccgaatttcatatccagccaagtaagcttcataagtgaaggagaaataaaatccttaacagacaagcaaatgctgagagattttgtcaccaccaggcctgccttacaagagctcctgaaggaagcactaaatatgtaaaggaaaaaccagaaccagccactgcaaaaacatacctaattgtaaagaccatcaacactgtgaagaaactgcatcaactaatgggcaaaataaccagctagcatcataatgacaggatcacattcaaacataacaatattgaccttaaatgtaaatgggctaaatgccccaattaaaagacacagactggcaaataggataaagggtcaagacccatctgtgtgctgtattcaggagacccatctcatgtgcaaagacgcacataggctcaaaataaagggatggaggaatatttaccaagcaaatggaaaggaaaaaaaaagcaggtgttgcaatcctagtcactgaaaaatagattttaaaccaaccaagatcaaaagagacaaagaagggcattacataatggtaaagggatcaatgcaacaaggaaagataactatcctcaacatatatgcacccaatacaggagcacccagattcataaagcaagtttttagagacctacaaagagacttagactcccacacaataatagtgggaggcgttaacaccccactgtcaatattaggcagatcaatgagacagaaaattaagaaggatattcaggaattgaactcagctctggaccacggagacctaacagaaatctacagaactctccaccccaaatcaacagaatataaattcttctcagcaccacattgtacttattctaaaattgatcacataattggaagtaaagcactcctcagcaaatgcaaaagaatggaaatcataacaaacagtctctcagaccacagtgcaatcatattataactcaggattaagaaattcactcaaaaccacacaaatacatgaaaactgaacaagctgctcctgaatgactactggataaataacaaaattaaggcagaaataaataagttctttgaaaccaataaaaaaggcacaatgtaccagaatctctgggacacagctaaagcagtgtttagagagaaatttacagcactaaatgcccataggagaaagcaggaaagagctgaaactgacaccctaacgtcgcaattaaaagaactagagaagcaagagcaaacaaattcaaaagctagcagaagacaagaattaactaagatcagagcagaactcaaggagctagagacacaaaaacccttcaacaaatcaatgaatccaggagttgttttagaaaagattatcaaaatagatagactgctagccagactaataaagaagaaaagagagaagaatcagacagacatagtaacaaatgataaaggggatatcaccactgatcccacagaaatacaaactaccatcagagaatactataaacacctctatgcaaataaactagaaaatctagaagaaatggataaattcctggacacatacaccctcccaagactaaaccagaaagaagtcgaatccctaaatagaccaataacaagttctgaaattgaggcagtagttaatagcctaccaaccaaaaaaagcccaagaccagatggattcacagccgaattctaccagaggtacaaagaggagctggtatcattctttctgaaactattccaaacaatggaaaaagagggactcctctctaactcattttatgaggccagcatcatcctgataccaaaacctggcagagacacaacaaaaaaggaaaatttctggccaatatccctgatgaacattgatgagaaaatcctcaataaaatattggcaaaccaaatccatcagcacatcaaaaagctaatccaccatgatcaagtctgcttcattcctgggatgcaaggctggttcaacacacacaaatcaataaatgtaatccaccacataaacagaatcaacgacaaaaaccacatgaatatctcaatagatgcagaaaaggccttcgacaaaattcaatagcccttcgtgctaacaactcctaataaactaggtattgatggaacgtatctcaaaataataagaggtatttataacaacccacagccaatatcatactgaattggcgaaagctggaagcattccctttgaaaaccagcacaaggcaagcatgccctctctcaccactcctattgaacatagtattggaagttctggccacagcaatcaggcaagcggaagaagtaaagagtattcaaacaggaagagaggaagtcaaattttctctgtttgcagatgataggatagcatatttagaaaatcccagcatctcatccccaaatctccttcagctgataagcaacatcagcaaagtctcaggatacaaaatcaatgtgcaaaaatcacaagcatttctatacactaataatagacaaacagagagccaaatcataagtgaacttccattcaaaattgctacagagagaataaaatacctaggaatacaacttacaagaaatgtgaaggacctcttcaaggagaactacaaaccactgctcatggaaataagacaggacacaaacaaatggaaaaaacattccatgctcatggataggaagaatcaatattgtgaaaatggccatactccccaaagtaatttatagattcaatgctattcccatcaagctaccattgactttcttcacagaattataaaaaactactttaaatttcatatggaactaaaaaagagcccgcatagccaagacaatcctcagcaaaaagaacaaaactgaaggcatcatgctacgtgacttcaaactatactacaaggctacagtaaccaaaacagcatggtactggtacgaaaacagatatatagaccaacggaacagaacaagtcctcagaaataacaccacacatctacaatcatgtgatctttgacaaacctgttgaaaaacaagcagtggggaaaggattccctatttaataaatggtgttagaaaattggctggccatatgcagaaaactgaaactggattccttccttataccttattacaaaaattaactcaagatggattaaagacttaaacataaaacctaaaaccataaaaaccctaaaagaaaacctaggtaatactattcaggacataggcatgggcaaagacttcatgactaaaacaccaaaagcaatggcaacaaaagccaaaatagacaaatgggatctagttaaactaaagagcttctgcacagcaaaagaaatgatcatcagagtgcacaggtaacctacagaatgcgagaacatttttgcaatctatccatctgacaaagggctaatatccagaatctacaaagaagttaaacaaatctacaagaaaaaaaaatctgatcaaaaagtgggtgaaggatatgaacagacacctctcaaaagaacacatttatatggccaacaaacatgaaaaaaagctcattatcactggtcattagagaaatgtaaatcaaaaccacaatgagataccatcttgtgccagtgagaatggtgatcattaaaaagtcaggaaatgacagatgctggagaggatgtgaagaaataggaatgcttttagcctgttggtaggagtgtaaattagttcaaccattgtggaagacagtgtggcgattcctcaaggatctagaacaagaaacaccatttgactcagcaatcccattactgtatatacccaaaggattacaaatcattctactataaagacacatgtacacatatgtttattgtgacactgttcacaatagcaaagacttggaaccaacccaaatgcccatcaatgataggctggataaagaaaatgtggcacatatatactatggaatactatgcagccataaaaaaggatgagttcatgtcctttgcagagacatgggtgaagctggacaccatcattctcagcaaactaacacaagaacagaaaaccaaacagtgcatgttctcactcataagtgggagttgaacaatgagaacacatggacacagggaggggaacatcacacaccagggcctgtcggagggtagggagctaggggagggaggggtagcattaggagaattacataatgttgatgatagtttgatgggtgcagcaaaccaccatggcacatatatacctaaacctgcacttcctgcacatgtatcccagaacttaaaatataataataataataataaaggggtattgaaattccccagtatttttgttttgctatgttttcctcatgtccactaatatttgctttatatgtttacacaccttgatgttggttgcatatttataattgttacagtctgattaacttatttgcttattattacttaaagacaatcttagtctcttgtaacagtttttgacttctggcctactttatctgacataaatatagtcacccctgctttctttttttaccgtttgcatgaaaaaattctttcttttcactttatttttgtccttaagcttgatctagtctgccattgaagctctctattgtattttttcatttccttcattgaataatctaatggcaagacatctgtttaatttttcttgatgtctatttctttgctgaatttctaatttataccatgatttttttttcctgatttctttcaatagtctatctatattatcttgaatcttgctgactttttattttttatttattttttatttttttaattatactttaagttttatggtacatgtgcacaacgtgcaggtttgttacatatgtatacatgtgccatgttggtgtgctgcacccagtaactcgtcatttaacattaggtatatctcctaatgctatccctcccccctccccccaccccacaacaggccccggtgtgtgatgttccccttcctgtgtccacatgttctcattgtttgattcccacctatgagtgagaacatgcagtgtttggttttttgtccttgcgatagtttactgagaatgatgatttctaatttcatccatgtccctacaaaggacatgaactcatcattttttatggcttcatagtattccatggtgtatatgtgccacattttcttaatccagtctatcattgttggacatttgggttggttccaagtctttgctattgtgaatagtgtcgcaataaacatacgtgtgcatgtgtctttatagcagcatgttttataatcctttgggtatgtgcccaggaatgggatggctgggtcaaatggtatttctagttcaaatcttgctgacttttaaaaatgttatattattattattattattattattattattattattttgagatggagtctcactctgtcaaccaggctggagtgcagtggcacgatctcggctcactgcaacctccacctctcagattcaagtgattttcctgcctcagcctttttggggagagtcatgtttctttgctttttcatgtttcttgtgtccctgtgttgatatatgtgcatctggtagaacatttgcctctcctaacttataaagtagcttttctaagaaaaaactttcacttgttgataggtcctcgggtgctgagtagggtgtatcggctctgcttctggctggcacagtagcgtagtctctgtgaagcttctcagctataatcaatgtcagtgacaagtggatgcctcagtggcccgtactgcagtaatttgtgggagtggtggtagcaaagtagattacactgagctcaggcaccaagagagcacaactactccaccagctcaggtacagcttccctcgggtgggatgcagggctggtttgtgtgctgagggaataagaccagtgttctggcttgggcatagcttttctggaggtggggcaccaggccgctttatgtgccaagggagcacagctgctccaccatctcagacattgctttcctggggctgagtctggggcccccagttagtgtgcacacaagggggtattgttgccattctattgcgcatgcttctctggggtcaaggtgcttggctcatgcttgagagggtacaactgcttcaccaggccaggcttggcttccttgctgggttggactgtttggtccttgggggccagagcagcctgtaggttcagaagcctgggtcatgaccgttccactgggcctaggcctaggcttcgaatggccatgggtggggcatagctgccactggaatggagaggatactgtgccttctcagcagcttcataaaaaggtattttggtctatatatccttggtaaatctgtatttctgagacagcatgagatcaataattttctattctactctcttgcttacaacattcaacaactcatttcctttttttttttatcacagagtaatattccattgtatagatgtaccatagtttgtgtatacattctatgtatcattattgaatgatatctggttgcaaacatttttggcaattatgaataaagctgctataaacattcatgtgcaatttttcatgtggacatatgttttcaagtcatttaggtgaataaaaagcagtgcagttgctggattaggtgataaaagtatgtttaattttgcaggaaattgctgaactgtcttctagaacaaccgtaccgtcttgcattcctgtcagcaatcagtgagaattcctgttgctccgcatcctcaccagcatttggtgttgtcagtgttctagattttagactaaatgcagtgttttcattttgtcctattctagatgctaacttttattgtgatttagtctcgtgagttgttttaaattgttacataagaatttcttagtgtatagagtttcctatgtttttgaattactttttaattttaattgcattatgattagagtatgtttattttgatggttatctgtggaaattttcattctgatctagttaagtggtgactttgtgagtttccgtgtgcttaaaaagactgcaaatctctcattgtggctgccctggaacttagtttatataataaataagtttcctcatgtctgaacctgcccaggcacctttcccaatgtatcagatgtttaacactaaggatctgttttgttctggaaagttatttttatctggcctcatgattacagtcctggccctgaacttcagagaatggaggggtaagcaaaaggacctcagactgtgccaggaaatgtcaagtcacctgctgtaggctactactaatggagcatggcctatttacttggacaccaaactatccagtgctaacatgaggtttttcaggactagatcccatggccatacagccctgcctgccagattggacgtgaaaagtatttccgcatctgacattcctgtttcacccacacagggcatcgttttgcccaggacaaagttcacctccaatcttatccacactatttctatctttgcttccttgataagatatagacatttatgcagtggttcaaagtctagagtccctacacttctggtacatgacagctgtgtctcgatggagtagactctcagaacagcgcagtttgccctccgctcacgcagagcctctccgtggcttccgcaccttgagcattaggccagttctcctcttctctctaatccatccgtcacctctcctgtcatccgtttccatgccgtgaggtccattcacagaacacatccatggctctcatgctcagtttggttctgagtctcctcaagctgggatcaggtaagactcatctttgtttcctccttactaactaacagtttgagttctttagctacaatggttgcagcataatggaatgaaggcatctttgtcgtttccattcctttggcttctcctagcctcagcctggggaaggatcaggcgctgtggaaacaattatagtagcccccaaataatggaaacacgggtgttgaagacgcaccgtgatcgttgacggggacacacctaacgtgttaaggtgaataaattcagtgtttctcccagatgggctgagtggtgtaggcagggttattggagcaccaaggttgctgacatggatgtccatctgggaagagacacagttaggatttttggggaaaagacaatgtatccagctaaagacatgctgagttagaaatgtctgtggtatgagacacgagggtggaggaaggtgtacaggtcttgaggtgagaaattagctgaaacctggcatattctgggaagaaatccactcttctttctccttccagttactgttaacacagaacctagtatataggatgttgagtgactgaatacaattcacagaggaagcttgaggttggggtagaatgctggtggctagatggtcagtacccagccacagaagattcgattgactgtgttcactttctgtctgtgaaggttcatcctgccacctgtccacctatatcttttttgctaaatgaagctaagaaaacagaaataagggcaatcaaaacatagagcatgtttccttaaaacaaaaacccatatgtgttactaacaggagacgctctcgtttcagtttgttttcatttattttctgacgagcttctttgtttcccttctgtttccgggtgaggcagcaggacatcctggaaatgatcttggagacagaaacattttatttttaaaaactcttatttcattttcttgtgagctttattgttcacagcttccttaggtgttggtttgcttatgatgacatggagatacgatcacattcctgctggggctgtggtgaggactgcatgagcttgtgcatgtagagtgcacacagctgcacgggtgcatggcatgttgcagcaacagtcttgttcctttcttattttcaagggaaggaagtggaaggagtgaaaggagatgttataggcaagagaggtgacagcagcaagggctggccggagaaatggaggtaccctgaaaaatgtttccttgcctcaagagccccacacagccctgaaggcagcatccatagcagcccagctggcatacgctgggtccccaaacctgacctaagacaagggccttcctgccagtgattcgttgagcaggtgattctgggaaacaaagtgagggagtggagagagtgaagccagtagggggaaagccatagagggtgcgctaatgagcgttgctgcggtggcaactgggacccagtcccactgggacctttggaggaactttatagatggtggctcagagtcattccaacatctactgtctcctttccccactgggtgagatgtgccgcccaggactgctaaaatcgcaaaccttctgagctgccttgtgccagggctaagtaggttccaagggtggcaggaagccctcagcagagaggcagaggccaggctccagggacggagctgtcagcaggcagggaaatgcccatcccactgcagggggactcagggttgggtggtgaggagcagggcctcaacatctgctacaccaggtcagaagctggtcagacaccaggctgcaaagtcatgcctcatttaataatactcttaaagatgcatgagtgaaatacatttcagcaagatttataaaatgtaattaaactaaaaaattagtgctaaaatgaaaaagtatccactgatctagaaattcacacatgtaattcaccttccctctgatgcacatgcagacagcacacacaggtatatccatataccataaatggatacatgtgaatgaatcaagagacactgccagtcaaagggggtgggtacttagaaggtgaagggagtgggcctccatagtctgtggtctctaagaagcagtgtaatccttacagggtagtaagagtgatttacaccaggaaaattactcaaatgattgttaaacagatgagcaagtaagaaaggaaatggggctcaccgttcacatgcataactgtggagcctgttctgtgtgactggctctgtgctgatcaagtgggtactatgctgagcaagaaaatcaggccctgtccccagagagccaagagctgtgcaggggaggctcacagaaaacatgtaattgtcacacttgaagcaagacaatgaagaaagtttcaaaagcgaggtgaggacatacatgtaccaagaattttttttaaaaaaaatgaaggcaagacatgttgacaaagcactaggcgaaccacctttcagtgctaaaataaagtggaaaaaattactacacaagcgtaaaaggcacatgctatggaaaatataagtcacacgtgaacgtgctaaagaacaaatttacagaaaacagactgcaaaatcttgtttcagtgtcacagcatgtctttcagaacttggcagaacaagcagattttcaaaaaaaactaaggaagtacaaataattgtgtgcgccatgggcagaaatgtaacattcctctatagtagccataaaatattgatataatattgtgcttgaaggaaaccttaacgaattgccgcaaactggagactttatggcccatactcttctctgggccattagaaagacgtcaactttggttttcagcaaggacgatggaaatggggatgtttgggttttttttttaattgaagcaaatgggcagatgggagagaatgtggcaatagaacctcctggaatcaaagggtctacattcagaaagagactttttcctctggataacatggttttctcatcttaaaaataaaaacattaataatacacatttctgcaggtgctcctcaagatcgaatgaagtaactgatgtggacatggtttgtcaaatgtaaggagatacacaaatgcaagtcactggctttagaaataggattgtgatgaatgtttccccctgatgcacatctccagcccagcccaatggagccctgagtaggtcacactataaagggtttttttttttgtttttgcttttatactttaagttttagggtacatgtgcacattgtgcaggttagttacatatgtatacatgtgccatgctggtgcgctgcacccactaactcgtcatctagcattaggtatatctcccgatgctatccctcccccctccccctaccccacaacgtccccagagtgtgatattccccttcctgtgtccatgtgatctcattgttcaattcccacctatgagtgagaatatgcggtgtttggttttttgttcttgcgatagtttactgagaatgatgatttctaatttcatccatgtccctacaaaggacatgaactcatcattttttatggctgcatagtattccatggtgtatatgtgtcacattttcttaatctagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttccagttctagttccctgaggaatcgccacactgacttccacaatggttgaactagtttacagtcccaccaacagtgtaaaagtgttcctatttctccaatcctctccagcacctgttgtttcctgactttttgatgattgccattctaactggtgtgagatggtatctcattgtggttttgatttgcatttctctgatggccagtgatgatgaacattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttctgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcaggctcttttttggttccatatgaactttaaagtagttttttccaattctgtgaagaaagtcattggtagcttgatggggatggcattgaatctgtaaattaccttgggcggtatggccattttcacgatattgattcttcctacccatgagcatggaatgttcttccatttgtttgtatcctcttttatttccttgagcagtggtttgtagttctccttgaagaggtccttcacatcccttgtaagttgtattcctaggtattttattctctttgaagcaattgtgaatgggagttcactcatgatttggctctctgtttgtctgttgttggtgtataagaacgcttgtgatttttgtacattgattttgtatcctgagactttgctgaagttgcttatcagcttaaggagattttgggctgagacagtggggttttctagatatacaatcatgtcgtctgcaaacagggacaatttgacttcctcttttcctaattgaataccctttatttccttctcctgcctaattgccctggccagaacttccagcactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctccgtttatatgctggattacatttattgatttgcgtatattgaaccagccttgcatcccagggatgaagcccacttgaccatggtggataagctttttgatgtgctgctggattcagtttgccagtattttattgaggatttttgcatcaatgttcatcaaggatattggtctaaaattctctttttttgttgtgtctctgcctggctttggtatcagaatgatgctagcctcataaaatgagttagggaggattccctctttttctattgaatggaatggtttcagaaggaatggtaccagttcctccttgtacctctggtagaattcggctgtgaatccatctggtcctggactctttttggttggtaagctattgattattgccacaatttcagctcctgttattggtcgattcagagattcaacttcttcctggtttagtcttgggagagtgtatgtgtcgaggaatttatccatttcttctagattttctagtttatttgcatagaggtgtttgtagtattccctgatggtagtttgtatttctgtgggatcggtggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggctttgagattcttaatcctgagttctagtttgattgcactgtggtctgagagatagtttgttataatttctgttcttttacatttgctgaggagagctttacttccagtatgtggtcaattttgtaacaggtgtggtgtggtgctgaaaaaaatgtatattctgttgatttgcggtggagagttctgtagatgtctattaggtccgcttggtgcagagctgagttcaattcctgggtatcctttttgactttctgtctcgttgatctatctaatgttgacagtggggtgttaaagtctcccattattaatgtgtgggagtctaagtctctttgtaggtcactcaggacttgctttacgaatcttggtgctcctgtattgggtgcatatatatttaggagagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgcctctgcacgtgagatgggtttcctgaatacagcacactgatgggtcttgactctttatccaatttgccagtctgtgtcttttaattggagcatttagtccatttacatttaacgttaatattgttatgtgtgaatttgatcctgtcattatgatgttagctggttattttgctcgttagttgatgcagtttcttcctactctcgatggtctttacattttggcatgattttgcagtggctggtaccggttgttcctttccatgtttagtgcttccttcaggagctcttgtaaggcaggcctggtggtgacaaaatctctcagcatttgcttgtctgtaaagtattttatttctccttcacttatgaagcttagtttggctggatatgaagttctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttgtcctgccttgctagattggggaagttctcctggataatatactgcagagtgttttccaacttggttccattctccccatcactttcaggtacaccaatcagacgtagatttggtcttttcacatagtcccatatttcttggaggctttgctcatttctttttattcttttttttctagacttcccttcttgcttcatttcattcatttcatcttccatcgctgataccctttcttccagttgatcgcatcggctcctgaggcttctgcattcttcacgtagttcttgagccttggttttcagctccatcagctcctttaagcacttctctgtattggttattctagttatacattcttctaattttttttcaaagttttcaacttctttgcctttggtttgaatgtcctcccgtagctcagagtaatttgatcatctgaagccttcttctctcagctcgtcaaagtcattctccatccagctttgttccgttgctggtgaggaactgcgttcctttggaggaggagaggcgctctgctttttagagtttccagtttttctgttctgttttttccccatctttgtggttttgtctacttttggtctttgatgatggtgatgtacagatgggtttttggtgtggatgtcctttctgtttgttttccttctaacagagaggaccctcagctgcaggtctgttggagtaccctgccgtgtgaggtgtcagtgtgcccctgctggggggtgcctcccagttaggctgctcgggggtcaggggtcagggactcacttgaggaggcagtctgccagttctcagatctccagctgcgtgctgggagaaccactgctctcttcaaagctgtcagacagggacatttaagtctgcagaggttactgctgtctttttgtgtgtctgtgccctgcccccagaggtggagcctacagaggcaggcaggcctccttgagctgtggtgggctccacccagttggagctgctttgtttacctaatcaagcctgggcaatggcgggcgcccctcccccagcctcgctgctgccttgcagtttgatctcagactgctgtgctagcaatcagcgagactctgtggtcataggaccctctgagccaggtgtgggatataatctcgtggtgcgccgtttcttaagcccatcggaaaagcgcaatattcgggtgggagtgacccgattttccaggtgcgtccgtcacccctttctttgactcggaaagggaactccctgaccccttgcgcttcccgagtgaggcaatgcctcgccctgcttcggctcgtgcacggtgcgcgcacccactgacctgcgcccactgtctggcactccctagtgagatgaacccggtacctcagatggaaatgcagaaatcacccatgttctgcgtcgctcactctgggagctgtagaccggagctgttcctattcggccatcttggctcctccccctcactacaaagggttttgatgatttatcttttgtatgtcttcccacagggcagtggcaggtgtttgggccagacaagcctgtccaggccttggtgggggaggacgcagcattctcctgtttcctgtctcctaagaccaatgcagaggccatggaagtgcggttcttcaggggccagttctctagcgtggtccacctctacagggacgggaaggaccagccatttatgcagatgccacagtatcaaggcaggacaaaactggtgaaggattctattgcggaggggcgcatctctctgaggctggaaaacattactgtgttggatgctggcctctatgggtgcaggattagttcccagtcttactaccagaaggccatctgggagctacaggtgtcaggtcagtttcatatttcataacttagttgtcccaaagaaccatcctggactttataagtgtttttttcaataaggaaattttaaaattttaggtcatttagttagaaggcagcattctatactctacgttccttctgtcttgtgtgtatagttctatgtgttttgtcacatgtttaaattcaggtaaccaccatcacatcaaggtatagaactaccccatcatcacgaagatctccctctgtcaccccttcatggtcacacccaccccttctcagcccctgcctggggttttccatctccctgatgctgtaatttcaagaatgttacatacacagcttcacaccgcaggtgaccttttgagattgactttttaaattcagcataatgctcttgcgatctatccaaattattgcttgtatcgatactttatttcttttttttccccactgtcaaaatagttttccttatgaacatttatttttaaattaacaaataaagattcctgctcacttgtcctacaaattttttgtttatctgatacagcagggagcaaacgtcagctccaggaagctgtgacttcccctgacaatcagttgctcaatgctctgtgttaacttgaccatacttccatagtcacacccttcacagtgaaatgtatttgacggggctgggtgcagtggctcaagcccgtaatcccaacaccttgagaggctgagacaggaggattgcttgagtccaggagctcgagaccagcctgggcatatggtaagacctcatctctattaaaaaaaaaaaaaaaagaagatgaaagaaggaaaaaacagaaatttattgtttacagttgttgccgtgtgcagtcagtgagttgtgaataatctgtgtcctgattaaaaacctgtgagtggggctgctctgacggtagtggattatccgaacttagtagtgtcactacaattggcatacgactccccactgctaaatttgactaacttaaatttttttaaaaaccactatgagtgatatttcaggcctgatgataggcaattttcaaaagcgtttcctggaaggcctcctcctcatagcagacttggagtacaaccaatgctttgcagtctctgaggagagtttcaggtgagccctcaggcccggctaagctgtcctggtctttacatatttgcatttctagcccaggcattttaattctcagaatctcaggccttgggcaggactttcaagtgccttataacaaggaggagaatgtggagtcctaattagggaaaaggagtcaggctggcaggaccaggtgaaagcaaaaagaaaaaaaaaaagaggaaataaactataaacatgcctttcttcatgtctagaaaatttaaacaaaagagacagcagataagctacaggtctgcctttcttcgtcatcctggacatacagtccaggatatatggcccagaacatttggccttcctgcccagataacatacataactcacagacttcctgcttatcatcaaacacctcaatttatcaaatatcccagctgacaaaagaatataagttaggctccctgctaccttggcattatcgatcagcccaagctccattctataaaatccctgagacttttttttcttgcagttagcttccctcatgctaacttgcctattgccttccttgcaaagtactttcctactttctctaataaatctgcctttctctacctacaaccatcttggtaaattcttttacccccacaccactggctgccattcccccatgacagaaaaggcaaactccaagacacttttctctactctgtcttagtatccagtatcttaccctctaattcctcctccctacacctcctcctgagctcaggattcataaagctgtgaagccttttgttcagcactccatcactagtgagtcagccccacacgtgtgatgatccatctgcccctcaactggaattccatttcatgggggaggatgagacagggaggggttggcatcttccttggtttagctcttacttttgtagcaactgattagaggcttcactattactttaattcgggtcatcgttcctttggtctgttactcctacgcctggcggctcagcactctctctactttagctgagctcctgacaagtttctcatagaagcagttttgtcttacttcatcatgactggtgcttaggaatagccacgcatacacagtagttgctaaaaaatggcaacgaacagaggccatgggaaggcttttgccaaaggtcgtggttttagtgtttgtgtgtgtaagagagagaatgggtggggggtggactgaatgcacctgactcagaattgctgtggctttgggatgtgatctttgctttcaaccgttccctgttttctccccagcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggaggtgagtagggaggggaggagaagagaaggaggggtggatgcttcggtaactcagagggaggacaggagcctccatcttggcattgctgttttatctttctcagttctaatgatttattttaaaagtttaaaatcaatgagatgtaaaagtaaagttataaacatttggttaggtggaaatagaattgtttacaattccaggggagtagaattaagtatttccttcagctgtgacgtaaccctgtgatggttaattttttgggtccacttgactgggtcacgatttgctcagatttggtcaagtattattcaggatgcttctgtgagggtgtttacacataagattcacatttgaattggtaaactgagtaaagaagattgccctccataatgcgggtgggcttatccaatcagctgaagacctgaatagaacaaagggtcgaccctcccctgagtgagagaatgatcttgcatagtagccttttaactgggacactggctcttcctggcctcagagcaggctgctggccttcagactcaaactgaaccactggctctttctatgtcttgagcctgcggacttttggacaggagtgacaccattggctcttctggttctcaggtcttctggtttcaacgtaaatgaaccattggctctcctggggctccagattgctgactcacccatgagttgggacctaaaagagcttccatgatgtatgcaagccaattctttatactaaatctgtctctcctcttcctttctctctttatctccatctttctctctcaaatatatagaaacaacaggatgtatatatatatatatatgtatgtgtgtatacatcctagtggttctgttactctggagaactctcactaatacagatttggtaccaagagtatttctagagaaaaagaattttagggataacttttcagtcatccctaaaattctaaaattctctgagctgggattactgtgtacacctgtagtcccagctactcaggaggctgaggtgggaggatcacttgagcctaggagtttgaggccagcctacacaacatagcaagaccccgtcttcaaacaaacaaaacaaaaagcactgaaagttcatgttgtgatctagcaatacagatatgcaaaatttcaccatttgcgacccataattaagcatgggttgactggtatatgatattttcaaacatgtgtgtcgacctagtgaataagatgagattggctggttgctcctattcttgctagaaaaagtgaggaaagtgatgaaaggaaatatgagcggaggaatttgaattctgagtttcttggtgttgcataaataacctgaaagcttccatgagtgccctgaaagagacccttattttctgtagccacagggctaagattgctgaaaaccaaattgagaactcattctgtgactggctgaacgacaatggaaatccaaacctgttcctcagggtatctgtcaatgtgagggggcattgactgggaagaaatgagattcagaaagttgaaatggggatgtatgggaagactgatgaagctggggacattgagcctcaaatgctgatgagtctttgccagtgaaagcagtctcagtctctctatgtcaattagaagtagcctctccaccttcatctcaggggattaaccctgcattgcccaaagaaactgtaatggcctctttcctgaggcagtcaccatgcaagacaatgctgatgctacgcaggacccacccctaccattcctctttgcttctagatctgtacctaggctcaagtttcagcaggaccctaaagttggaaacaatgcatgactcattagaaagtgtactacactccaaaagagctagttggtttttctaatctatacagaccagaaatccagagaatccatgtcaaatgatattaagggtgtaaggtggtggtacaaggacgtaaggttggctcaaaccacatgtaatggcctcactaatcagagatcctgcatttaatgttgcagctcagagtgttagaaaggcctctatcgtttggttggctgaagcatggatcaaaatgtggcccacagagagtgacaggtgggcatgctgttaggagcctttgccaggcccctgtaagtgaatcatggcacaggccctcaggattgagaagcagagccctgccattctctacgaataactactcttcttttgaaaaatacatcttgggctagaccttaggaaagactgaacacttaatcatgggccgccaagttgcaatgtgacttgaatcagtaagaatatagaatacttgaactaaaaattaacaaacccaatttaatagatattcttagaaggctgcacccaccacaaagcattggaagcacacacagaccataaattaactctcatcaggctcaagcacataaaatgctttacaaaaactttgaagaaaatggtattgcgatatggttttagtgttgtgtcttctccaaaattcatgttgaaacgaaatccccaatgcagcactattaagaggtgggctttttaggaggtgattaagtcctgaggactatgcccatatgaatgggttagtgccttataaaaggatttaagggggtgaacttaccctttccaccccttctgccatgtgagggacacagtgttcatcgccttcaggggacacagcaacaaggtgccatcttgaaacagaggacagtcctcatcagatgccaaatctattgatacttgaccttggacttcccagcctccagaactatgagaaatacatttctattgtttacaaatgagccagtctgtagtattttgttatagcagcacaaatggacaaagactggtatgattcaaacgatgatttctaatcacaatataattaaattcaatgagaaaaagaaaaacaatttaatattcatatatgtttgaaactttcaaaacatacttcaaaaataactaagtggtcattgaaaaagtcataatgataattaaaagtgtcttaggactgaatgataatgaaactatacatacaaactatcacacaactataccttttaagaagtgacatgattaggatggtgaaatggagttttcagttctcaaactcccacagaaacactaattttaacaactaccatgaacaaaagtatttttgtaggagtctaggaagccacttgagaggttccaactggttggtcaggcaaaaaagccaagaacagatgcatggaggaaggtaagaactgtttccttctacccgcctcactgctcttccgaggtaactcagtgccaagagagactccctcagcccacaatttttgccatggggaaagtgagagcaaagtgaatgtccagattccccaggcttgtgggatgctgcccaggaaacccatttctgtctcacttaatgcagaacactgaggggaccatgtggctgaatcatctgggggcagctaggagtagggaaagaggagggggcttatggcagccagtgcatggacctgaacaacaagcagcagaacctactggccagcccctgcactctactagaggcccacctcacaacctgctgactacccaaccagctgatatgtgcccccagccctccacacaccacccctgtggctagaacctcttggtccatcacagtggggcacgtgcttccctgcagacagggtgcctgagcctcagcagatgtgcatacaaacttctgcagtcagaacacagatagcaatcagcttgactctgctggattgagagaaggtgcacaatcttgagtattttagggaattgccctagggataaataaatgcaaggctctcagcagccagcctgctttgcaggactgagaaaagaaaatcccaagacttcctctcaccaagaaggaacgagaaaagtaaagcaggtacatccataaaaaagatctgagagacttccagagtatctagccaggctgactggtcaaggtctttgtctaccaaagtctgccagtacagactagaggaggaggagtgacagaaagacaaaatatactgtcaaacagattcacagcacattaaaagattcatttaccatgattaagtgagctttatccttggaacataaggatggttcaacatatgcaaatcaataaatattacactaacagaatgaaagacaaaaacaatatgatcatctcaatagatgcagaaaaagcatttgacaacattcaacaccctttcatgacaaaaccaactttcaataaattaggtatagaagcaatgtagctcaacacaataaaggccatacgtaacatgcccacagagcatatacccagtggttgtcttagtccactttatgctgctgtaccagaatacctgagattgggtaattgataatgaacagaggtttatttggctcatggtcgtggaggctgggaagtctaagatcaaggggtcacatcctgtgagggccttctagttgtgtaattccatggaggaaggtagaatggcaagagagtaagaaagaggaaggaagctgcttctgcaaaaatggcattaatccactcacgagggcaggatcctcatggccttgtcacctcttaagggtcccacctgtcaacattattgcattggggattaagttttcaacacataaactctggggatacattgaaaccacagtgatgatgaaaaatttttaaacaatagcgaaatctatggaatgtagcaaaaccagttctaaaagtttatagctataaatatctacattaagaaaaaagaaagatctcaaatgaacaacctaagtttatacctcaagaaattagaaaaagaaaaaactaagccaaaatttagcagaaggaaggaaaaaataataattagagcagaaataaatgaaatagaaaaacaataaaaagatcaataaaactaaatgttgtttatttgaaaagataagtaaaattgacaagcctttacctagattaaccaagaaaaaaagagctgactcaaataaatagaattataaataaaagatgatacattacaactggtaccacagaaataaatataaaatgtcatgagactatcgtagttctcccttatccacaggggttacattccaagatccccagtgaatgccacaaaccacgtacagtaccaaaccctatatatgctatttttcatgtctcaaatggaacagagcaggatgatagagatttcatcatgctactcagaatggtgtgcaatttaaaacttacaaattgtttatttatgaaatttttcattcaatatttttgggccacaattgatcacgagtaactgaaatcatgaaaagtgaaaccaaagacaaggttagactacggcactatgaaaaatcataggccaacaaaccagataacctagcagaaaccaaagacaaggttagactacggcactatgaaaaatcataggtcaacaaactggataacctagcggaaaccaaagacaaggttagactatggcactatgaaaagtcataggccaacaaactggataacctagcagaaaccaaagacaaggttagactacggcactatgaaaaatcataggccaacaaactggataacctagcagaaaccaaagacaaggttagactacggcactatgaaaaatcataggccaacaaactggataacctagcagaaaccaaagacaaggttagactatggcactatgaaaaatcataggccaacaaactggataacctagcagaaaccaaagacaaggttagactacggcactatgaaaaatcataggccaacaaactggataacctagcagaaaccaaagacaaggttagactacggcactatgaaaaatcataggccaacaaactggataacctagcagaaaccaaagacaaggttagactacggcactatgaaaaattacaggccaacaaattggataacctagcagaaatggatacattcctagaaacatacaacctataaaaactgaatcagaataatttaaaaaaaataccagaccagtaattagttagaaatacaattgataatcaaaatcctcccaacaaagaaaattccatgaccagatggctctgctggtgaattctgcaaaatatttaaagaaaaattaacacaaaaaattagctgggcgtggtggcgggtgcctgtaatcccagcactctgggaggccgaggtgggtggatcacgaggtcaggagatcgagaccatcctggctaacacggtgaaaccctgtctctactaaaaatacaaaagaattagccgggcatggtggcgggtgtgtgtagtcccagctacttgggaggctgaggcaggagaatggcgtgaacccgggaggtggagcttgcagtgagctgagatggcgccactgcactccagcctgggtgacagagtgagattctgtctcaaaaaaaaaaaaaaagaaataaacaaagaaagaaaaattaatgccaatacttttcaaactcttgcaaaaaattaaagatggggaataattccaaactcattttatgaggccacagttaccctgatacaaaaaccatataagaacaccataaaaaagaagaaaattacatgccaatatccctgataaacatagatgcaaacatttccaacaaatattagccaaccaaattcatgataaaaagaataattacaaagtacattaaaagaaacattaaacgtatccccatgatcaagtgggatttatctctgggatgcaagaatgtttcaacacacgcaaataaataaatataatatatgacattaacagaatgaagaacaaataatgtataattatgttaacaaacgcagagaaagcatttgacaatattcagcatcttttcataataaaagtcaacagactaggtaacaaaagaatgtacctcaacataataaagatcacatatgtgtcaacaaaaagagtcaaactctataaaacatttaaagaggtttattctgggccaaatgtgagtgaccaaagcccaaggcatagtctcaacaagtcctgagaacatgtgcccaaggtggttgagttacagcttgattttatgttttaaggggacagaaattacagacagacatcaatcaatatatgtaaggtgtacactggtttggtctagaaaggcaggacaacttgaaatgggggcttccaagtaataggtagattagaagattttctggttggcaaatggttgtgagttatctaaaagacctggaatccatagaaaagagtgtctagattaggatagggggttgtggagaccaaggttcttacatgtagatgaagtctcataagtggcgacccttagaggcaataggtggcaaatgtttcatattcagatctttaaaaattgctagactctcagctaatcagtctcttcgggatcagacaaagacctggaaagggaaatttacattctgtagagaatttacatttcccccaccagaggcagctttgccaggctatttcaaaatatgtcaaagaaatatgctttggggtaaaatattttaaattctttcagggcctgctatctgtcatgtgatgctatatgatagtccagttgggatttggtatcttattgctacaaagagtctgttttgtcagtcttaagacctctgttgtaatgttaatgctgctcagttgttcctgaactccaaagggaagaggacataatgaggcatgtccaacctcaccttcccatcatggcctggactagtccttcaggtttacttgggaattccctttcttgagaagagggggtccattcagttgactgggaagcttagaattttatttttggtttacatattataagctcatagctaacattatcctcaacactgaagtagtgaaagctttcctttaagattaggaacaagataaaggtgtccactcttgccacatagtattggatgttatagccagagcaattgggcaaaaaagaaaattaataaaaagcaaccaaatcagaaaggaagaaacataaatgtctctgtttggagatgacatgacacgtagtgagccctagagaatccactaaaacctgttagaacttaataaatgaatttagcaaagttgtaggatacaaaatcaacatataaaattagtagtgtttctatacactaacaataaattgtctgaaaagaaatcaaggaaacaacttcatttaaaatagcatcaaaaaattagaagtaaatttagccaatgaggtcaaagatctgtacactgaaaactataagacactggtgaaagaaatggactataacacaaataaatagaaatgtatcatgtgttcatagaattaatattgcttaatgttcatactacccaaatcaatttatagatttaatgcaatcactattaaaattcaaaggcatttctcacagaattagaaaacaatctaaattcacatgggatcacaaaagaccctgaatagccaaataagacttgagcaaaaagaacaaagtacaagcatcatactacctgatttcaaattatgttatattaggttggtgcaaaagtaattgtggtttttgccattgaaagtaatagcaaagactgcaaagacttttgcaccaacctaatagtaattaaaaccatatggtactggcataaaaacagacatatagattaatggaacagaattaagagccaagaaataaacccatgctatatggtcaactaatcttcagtaagattaccaagaatacaaaatggataaatgatagtttctttaacaaatggtgtttggaaaactggatatttacatgcaacagagtgatattggactcatattttccatcacacacaaaaatcaattcaaaatgaattaaagatataaacaaaaggccttaaactataaactcttagaagaaagcatacagaaaaatctccttgacattgatcttggcagtgatttttcaccctgacaccaaaagcacaggcaatgaaagcaaaaatgaacaagtaagattacatcaaactaaaaagcttttgcacagcaaaggagataatcaacaaaataaaaagcaacatgtggaatgggagaatattttcaaagtatatacctgataaagagttaatgtccaaaatatgtaagacactcatacaactcaataaccaaaaatattccaatttttacaatgggcaaagtacatgaataaacattttccccaaaagacatataaatattaatagccaagagatttatgaaaagtgactcactatcactaaccatcagggaaattcaatcaaaagtataaggagagatcacctcatacttgttagactggttattactaacttaagaaatattacaggtgttactacattgttgctgggaatataaattgatacagccactatggaaaacagtatgcagattccttaaaaaaatacaaatagaactatgctacatagtcttatatgtagataaaccctaaagattccacaaaaaactgttagagctaatacatttagtaaagttgcagtgtacaaaattatataaaataagtaacctcattgataatttataatccagcaatcctgcttccgtgcatttatccaaaagaattgaagtcaggatttcaaaaagatacttgcacttccatgtttattgtggcatagttcacagtagccaagatatgaaaacaatctatttgctgacagatgaatggatttaaaaagtgacatatgtaatgaaatattactcaacaataaaaaagaggtaatcccgacacatggatgaacatggaggacattatgttaagtaaaataagccagacataaaaatgatctcacttatatgtgtaatctaaaatcatcagtcatagaatcatagagcataactgtgattgccagggaatgaggggagggaaaaatgggaaggtgatattcaaaaggtataaaaaagtttcatttgtgcaagatgaagaagttctggagatctactatacagcacagtgcctgtagctaacaataaactattgtattcttaaattctgtgaagagggtagatcttatattctgctcatactacacacacacacacacacacacacacacacacacagacacacacacaataattgtaataattataataaaaggggtaggaggaaactacgggagatgatggatatgtctatagtcttgatggtggtgatgatttgaatgggtatatacttatcaccaaactctttgagttgtataaattaaatatgtacagctttttacatgtgaatcatacctatcatacttgataaatggttttatgaaacaaaaaacaaaacagaaaaataaattaacacctttaaataaatgtatccatttcttctagaatttctagtttgtgtgaatagaggtgttcataatagtctctgatagttatttgtatttttttggctcagtgtaatatcccctttgtcatttctgattgtgtttatttggatatttttttctcttttctttattagcctagctagtggtctatatattttattaatttttttcaaaatccaactctggattcattgatcttttgaatggtatttcatatctcaatctccttcagttcagctctgattttgttatgtcttatcttctgctaactttgggattgattttctcttggttctctagttcttttagttgtgataataggttcttaaattgagatctttctaactttttgatgtagttgtttagtgctataaagttccctcttaacagtgccttggttgtgtcccagaggtgctggtatgttgtgtcttttttctcattagtttcaaagaaattcttaatttctgccttaatttcattatttacccaaaagtcattcaggagtaggttattcaatttccatgtaattgtattgttttgagtgattttgttagccttgatctgtaatcgtattgagctgtggtctgagagagcggttgttatgatttcagttcttttgcatttgctaagaagtgttttgtgtctgattatgtggtcagttttaaagtatgtgctatgtagtgataagaagaatgtatatcctgttatttttgggtggagagttatgtagatgtctatgagatccatttgatccagtgtgagttcaggtcctgaatatcttgttaattttctgcctcaataatctatctaatacagtcagtggggtgttgaagtctcccactattattgtgtggaagtctaaatctctttgaaggtctccaagaacttgctttatgaatctgggtgcttttgtgttgggtgcatatatattcaggatagttatgtttgttgaactgaaccctttaccatcatatattgcctttctttgtctttttgattattgttggtttaaagtctgttttgtctcaaattataattgcaactcctgctttttcctgctttccatttgcttagtagattttcctacatccctttattttgagcctatggatgttgttgcgtgtgagattagtctcttgaagacagcataccatttggtcttgtttctttatccagcttgccactctgtgccttttaattggaggatttagccaataaggcagtttaaaaaatattaataagaaattttcagaaacataaatgtaaaattccaattagaaattttataaactccaagcaaatgttttttaaaaaacctaatatattatgactgaattgagcttacccaggaataaaaggttaggtcaacattgggatatgtatatttatgtaagtattaccttaataagttaaaggagaaaatctataagattctctatagatgttaataaaacatatataagtttcaacatctaactatgatttaaaacacttgtgaatccagaaataaaagaaaaccttttatgaattagcaacagaagagcagttctttcatctgatagaaagctatttaaaaatacccatagctaccatgatacatcatggtaggaggtttaaacccaggaacttaatgaagataactgcattaaacattgctgttcaacaatatgctggaatagtaatcattgcaaaaaaagaaagaaagtgaaaaaagaattacaatttccaggaaggaaaaaatagaatgcctatttccaacaggttatatgataatacacattggaaatctggattaatctacagacaaattctttcaatttatacttcattatgttcataaaaataagatcagtaaacaaaatacattgcattttatacaccagcaaagacagaaaaacaaacaaatatgccatgtataataacacaaaatgtcacatagaaatatatttaataaaatatttttatactcttattaaggattagataagtttactaaaataactaaaataagaggagagacacatctggccctactgagccccactggtcaagtagcaacacaattcctgatgctgtctttaagccttactcagcgtgggaggcaagtgcacactggcagttgaccatacagggagcatctggccctggccaacctcagcagctgagcagcgactcagccagccttgggttctctttgcatattccctagataggaagacaatagcagctctgtgattatctacagagggagcatctgatcttgcccagacccagtagctatgcagcaactcaacccaccattggtgttctgcttaaggctactctagactaggagccaagcccaagtccacacacatctgtggagcatagcctctggccctgcccaccctgagtgatcaagcagcaaccccagaaatctcacccagcctcagagctcagcacacgtccctgaccaactacagattccaaacaacagtaccatctagcaagaaagacaacctctaaccctggacaatcaggcaactgcagagcccaatcagcagcaccacctgtcacaggagcacagccagcagttccatttaatgtcagagcacaggtagtggcccagcccaactagagaacccaacacccacatctgcctgtctgaggttgctaccagttggcctattcagaatcccaggctatattaaatagtgaagacctcttactgagaaagaacacttgcaaaggccagaaaaggtggccatttcttcaaatgtgcaggcaccaacacaaagacagaaggattattttaaaaatcaagaaaatatgacaccaaaagaaactaataatgctccggtaatagaccctgaaatatgcaagtctatgagaccactaagaatttaagataatccccttaaagaagttcaggaaactacaagaaaatgcagatagaaaataaataacatttgaaaaatggttaatgaacaaaaagaaaagcttgacaaaggaataaaaacaataaaatagttaaaatcctagaaatgatgaatacaataactgaaccaaaatattaactagaaagcttcaacagcagacttgatcaaggcaaagaatcactgggcttgaagactggatattttaaattatccagtcagagaataaaaaagaaaaaagaataaaaaatgaaaaagacctataggaattattggacaccattaagtgtactgacttttgcataataggagtttcagaaggagatgagagagaacaagatcccgaaggcatatttaagaaaataatggctgaaaatttcccaaatgtggtgaaacacaaaaatatccaggttcaggaagcttggatgtcatcaatcaaattcaacccaaagaggattttaccaagatatatcatattccaattatcaaaaaatcagagacaaagaaagaatactgaaagcagcaagagaatgaaccatatcgcattcaagagagccccaatatggttttcagcctttctcttagcagcaatcctgcatgccaggaaagaatggcattatgtattcaaagtgttgaaggaaaagattgccaatcaagattacattactagcaaatctgtccttcagaaatgagggagaaataaaatctttcccagacaaacaaaagctatggtaattaatcattattagatctattttataaatattactaaagggagccctttaactaaaacaaaaggattataataacaaaaacatatggaagtaaaaaactcactggtaaaaataatatatagtcatattcagaattctctaatacagtaagggtggtatttaaagctaatttatccctactgtcacagttaaaagacaaaattattaaaagcacctataactaaaataaattgtaaagaaatacaaattacaaaacatgtaaattttgacatcaaaatcataagaagtggaaaggagtgaaagtgtagagtttttgtatgtgattaaagttatcagaataaaatagcctgttaaaaggatattttgtgtatgcctcatggtaaccacaacacaaaaaaaccacagcaggcggtggctggcaagatggccaaataggaacagctgcggtctgcagcccccagcaagatcaatgcagaagggaggtgatttctgcatttccaactgaggtacctggctcatctcattgggactggttagacagtgggtgcagcccacggaaagggagctgaagtagggtggggcatcacctcacctgggaagtgcaaggggttggggaactccctctcatagccaagggaagatgtgagggactgtgccatgaggaatggtgcactacaacccagatattatgcttttcccatggtctttgcaactcatagaccagaagattcccttgggtgcctacaccacccgggccctgggttttaagcacaaaactgggtggccgtttgggcagacaccaagctagctgcaggagattttcataccccagtggcacctggaatggcagcgagacagaaccattcactcccctggaaagggggctgaagccagaaagccaagtggtctagctcagtggatcccacccccatggagcccagcaagctatgatccaagggcttgaaattctcactggcagcagagcagtctggggtcaacccaggacactcgagcttggtgggcagagggacatcaccattactgaggcttgagtaggcagtttttccctcacagtgtaaacaaagccaccaggaagttcaaactctatggagcctactgcagcttggcaaagcctctgtagccagactgcctctctagattcctcctttctgggcagggcatctctgaaagaaaggcagcagccccagtcaagggcttagagataaaactcccatctccctgggacagagcacctgggggaaggagaagctgtaggcacaacttcagcagacttaaacgttcctgcctgcctgctctgaagagaacagcagctctcccagcacagtgcttgagctctgctaagggacagactgcctcttcaagtgggtccctgacccctgtgccttttgactgaaagacacctcccagcaggggtcgacagacgcctcatacaggagagctccggctggcatatggtggatgcccccctgggacgaaccttacagaggaaggagcaggcagcaatctctgctgttctgcaccctccgctgatgatacccaagcaaacagggcctggagtggacctccagtaaacttcagcagacctgcagcagagggtcctgactggtagaaggcaaactagcaaacagaaaggaatagcatcaacatcaacacaacaaaaaggatgtccacacagaaaccccattcgaaggtcaccaacatcaaaaaccaaaggtagataaatccatgaagatgaggaaaaaccagtgcaaaaaggctgaaaattcctaaaaccagaatgcctcttctgttccaaaggattacaactcctcaccagcaagggaacaaaaccggatggagaatgagtttgatgaattgacagaagtaggcttcagaaggtgggtaatagcaaactcctttgagctaaaggagcatgttctaacccaatgcaaggaagctaagaaccttgaaaaaaggttagaggagctgctaactagaataaccagtttagagaagaagataaatgacctgatggagctgaaaaacacagcatgagaactttgtgaagcatacacaagtatcaacagccaaatcgatcaagtggaagacaatgatatcagaaactgaagatcagcttaatgaaattaaacatgaagacaagattagagaaaaaaagaatgaaaaggaacaaacaatgcctccaagaaatatgggactatgtgaaaagaccaaacctacgtttgattgctatacatgaaagtgacggggagaatggaaccaagttggaaaagattctccaggatactacccaggagaacttccccaacctagtaagacaggccaacattcaaattcaggaaatacagagaacaccacaaagatactccttgagaagagcaaccccaagacacataatcgtcagattcaccaaggttgaaatgaaagaaaaaatgttaagggcagccagagagaaaggttgggttacccacaaagggaagcccatcagactaacagtggatctctctgctgaaaccctacaagccagaagagagtgagggctaatagtcaacattcttaaagaaatggattttcaacccagaatttcatatccagccaaactaagcttcataagtgaaggagaaataaaatcctttacagaaaagcaaatgctgagggattttgtcaccaccagacctgccttacaagagctcctggagaaagcactaaatatggaaaggaaaaaccagtaccagccattgcaaaaacacaccaagttgtagaaactgcatcaactaatgggcaaaataaccagctagcataataatgacaggatcaaattcacacataacaatattaaccttaaatgtaaataggctaaatgccccagttaaaagacatagactggcaaatttgataacgggtcatgacccattaatgtgctatattcgggagacccatctcacgtgcaaagacacacataggctcaaaataaagagatggaggaaatttaccaaccaaatggaaagcagaaaaaagcaggcgttgcaatcctagtctctgataaaacagactttaaacaaacaaagatcaaaagagacaaagaagggcattacataatgataaagtgatcaatgcaacaagaagagctaactatcctaaatatatatgcacccaatatagaagcacccagattcataaagcaagttcttagagacctacaaagagacttagactcccacacaataatagtggaagattttaacacccaactgtcagtattagacagatcaacgagacagaaaattaacaaggatattcaggacttgaactcagctctggaacaagtggaccctataggcagctacagaactctccaccccaaatcaacataatatatattcttctcaggaccacatcacacttattctacagttgatcacataattcgaaacagaacactcctcagcaaatgcaaaagaatgtaaatcataacaaacagcctctcggaccacagtgcaatcaaattagaactcaggattaaaaaactcactcaaaccacaaaactacatggaaactgaacaacctattcctgaatgactactgggtaaacaatgaaattaaagcagaaataaataagctctttgaaaccaatgagaacaaagacacaatgtaccagaacctctgggacacagctaaagcactgtttagagagaaatttatagcactacatgcccacaggagaaagcaggaaagatctaaaatcgacaccctaacatcacaaataaaagaactacagaagcaagagcaaacacattcaaaagctatcagaagacaagaaataactaagataagagcagaactgaaggaaatagagacacaaaaaacccttcaaaacatcaatgaatccaggaggtggttttttgaaaagattaacaaaatagatagaccgttagtgagactaataaagaagaaaagagagaggaatcaaatagacacaataaaaaatgataaaggggatatcaccactgatcccacagaaatacaaactacaatcagagaatactataaatccctctacacaaataaactagaaaatctagaagaaatggataaattcctggacacatacaccctcccaacactaaaccaggaagaagtcaaatccctgaatagaccaataacaagttctgaaattcaggcagtaactaatagcctaccaatcaaaaaaggcccaggacaagatggattcacagctgaattctaccagaggtacaaagaggagctggtactattccttcagaaactattccaaacaatagaaagagagaaactccttccctaactcattttatgaggccaccatcatcctgataccaaaacctggcagaaacacaacaaaaaaggaaaatttcaggccaatattcctgataaacatcaatgtgaaaatcctcaataaaatactggcaaagcaaatccagcagcacatcaaaaaccgtatccaccacgatcaagttggcttcatccttgggatgcaaggctggttcaacatacgcaaattaataaacgtaatccatcacataaacagaaccaatgacaaaaacattatctcaatagatgcagaaaaggccttcgataaaattaaacaccccttcatgctaaaaactctcaataaattagatgtcaatggaatgtatctcaaaataataagagctacttatgacaaacccacagccaatataatactgaatgggcaaaaactggaagcattccctttgaaaactggcacaagacaaggatgtcctctttcaccactcctattcaacatagtattggaagttctggcctgggcagtcaggcaagagaaagaaataaagggtattcaaataggaagagaggaagtcaaattgtctctgtttgcagatgataggattgcatgtttagaaaaccccggtgtctcagccccaaatctccttaagctgataagcaactttagcaaagtctcgggatacaaaatcaatgtgcaaaaatcacaagcatttctatacactaataatagacaaacagaaagccaaatcatgaatggactcccattcacaattgctacaaagagaataaaatacctaggaatctaacttacaaaggacgtgaaggacctcttcaaggagaactacaaaccactgctcaaaggaaataagagaggacacaaacaaatggaagaatattccatgctcatcgatagaaagactcaatatcatgaaaatggccatactgcccaaggtaatttatagattcaatgctatccccatcaagctaccactgactttcttcacagaattggaaaaaactactttaaagttcatatggaaccacaaaagagcccgtatagccaagacaatcctaagcaaaaagaacaaagctggaggcatcatgctacctgacttcaaactatactagaaggctacagtaaccaaaacagcatagtactgatacaaaaacagatatatagagcaatggaacagaacagaggccttaaataatgccacacatctacaaccatctgatttttgacaaacttgacaaaaataagcaatgggggaaggattccctatttaataaatggtgttgggaaaactggctagccatacgtggaaaactgaaactggactccttccttacaccttatacaaaattaactcaagatggattatagacttaaacataaaacctaaaactgtaaaaaccctagaagaaaacctagggaataacattcaggatataggcatgggcaaagacttcatgactaaaacactaaaagcaagggcaacaaaagccaaaattgacaagtgggatctagttaaactaaagagcttctgcacagcaaaagaaactatcatcagagtgaacaggcaacctacagaatgggagaaaatttttgcaatccatccatctgacaaagggctaatatccagaatctacaagaacttaaacaaatttccaagaaaaaaaacaaacaatgccatcgaaaagtgggggaaggatatgaacagacacttctcaaatgaagacatttatgtggccaacaaacgtgaaaaaaagctcatcatcactggtcattagagaaatgcaaatcaaaagcacaatgagataccatcttgtgccagttagaatggtgatcattaaaaagtcaggaaacaacccatgctggagagaatgtggagaaataggaaagtttttacactattggtggaagtgtaaattagttcaaccattgtggaagacagtgtggcgattcctcaaggatctagaaccagaaataccatttgacccagcaatcccattactaagtatatactcaaaggattataaatcattctactataaagacacatgcacacatatgtttattgcagcactgttcacaatagcaaagacttggaaccaacccaaatgcccatcaatgataggctggttaaataaaatgtgacacatatacaccattgaatactatgcagccataaacaagcataagtggaagttgaacaatgaaaacacatggacacagggaggggaatattacacactgggtcatgtcagggtgtggggggctaaggagggatagcattaggagaaatacgtaatgtagatgatgagttgatgggtgcggcaaaccagcatggcacatgtatacctatgtaacaaacctgcacattctgcaaatgtatcccataactttaagtataattatttttttcagatggagtcttgctctgtcgcccaggctggagtgcagtggcacaatcttggctcactgcaagctccccctcccgggttgacgccattctcctgcctcagtctcccaagtagctgggactacaggtgcccgccaccatgcctggctaatttttttttgtatttttagtagagacagggtttcaccatgttagctaggatggtctcgatctcctgacctcgtgatccgcccgcctcggcctcccaaagtgctgggattacaggcgtgagccactgcgcctggccaattttaagtataatttttaaaaagccacagcaattgcacaaacaataaaaaacaaaggattcaaagcatgcaactgtgagaaaacatcaaatttcaaaggaagacagccagagaagaattaaaaataaaagatctacaaaaccaacataaaacaaattataaaatggaagtctgtacctataaataaccttgaatgtaaatgggttaaattctccaattaaaatacatagactggctgaatgtatttttaaaatcaaccatatactactgtctataagtgactcacattactagtaaagacacacaaagtctgaaagtgaggggatgaaaaaggatattccatgcaaataaaaaccaaaaaaaaaaaaagcagtggtagctatacttatatgagacaaaatagactttaagtatgtaactataaaaagagaaaaaggtcattatgtaataatagagggttcaatttaccaagaacatataacaatataaatatatatgcacaaaacatcaaagcagttagtaaatattttaaggagagataaactgcaacacaatagaagtagggaacctcaaatcccactttcagcaatgaacagataatctagacacacaatcaataagaaaactttggacttaaactacatgttagagcaaatggacttaatagccatatacagaatattctatccaacaccagtagagcacacattcttctcaagtgcacattctccagaacatatcatatcttaggccacataaaaagttttaaatttaagaggattaaactcataataagtatattttcagaccacaatggtacaacctagaaatcaatagaaatcttggaaaacaggcaaatatgtggaaattaaacaacatgctttcaaacaaccatcgggtcgcaggaaaaaacaagaatgaaataaaaaatattttgagacaagcaagaatggaaacacaacacacaaaacttatggggtgcattaaaggcaaaaatgagagggaaatttatagcaatagacatctgtatcaaagaagaaggatctctaataaacagcctaatgttacacatcaaggaactagaaaaagaaaaaagaattacatccaaagaacagaacaataataagtaaggagactgacttagtaataaaaattctcccatcaaagaaaagcccaggacccagtgacatcactgatgaattctaccaaacatttaaagaaaaactgccagcatttctcaaactcttccaaaaaatgacagaggacatacttccaaacttattttacaaggtcaacattaccctgataccaatatcagacaaggacactgaaaaaaaaagaaaactacaggccaatattcctgatgaaaatagatgcaaaaattccaccccccaccaaatactagtaaaccaaataaaatagcacattaaaagaattgcccactgtgaccaagtatgatttaaccctaggatgcaaggatggttcaatatatacaaatataaatgtcatataacatataagcaaagtgaaggataaaaatcatatgataatctcaattgatacagagaaaatatttgataaattcagcaccctttcatgattaaaaatctctgaacatattaggtatacagggaatgtacttcaatacaataaaagccatatatgacaacccatagctaacattgccatggcatcctttgggtgttgcttttcctctggaaacctttgcccaagtttttcttaggcccattgggcttgttctgcccccttggccttgcaggctgtgcttggcttgtgataccagtccagatcccacacctgccaagggcgagccaggcacagagcagtgaggagtgcatgagtgagcgagcacaaaatctggccactgtgcacagccaggcatgctggctgctgtggtggagcaggcagctctaggcaccagcacaggtgccagctccatgtaaacctctgtgtggctagatcagatgcactgcaagtagcttccactgtaggcacctgtgtctggacgaggggaatgtggtggtgcctggaagcttggaaatgccagaaaccatacaggcccaaagagggtgtcacagtcctggcatgggaagcccctaggtctgggctcctggaagggctgcagctcttctctccttctcattgtctgcaacattgcaaacagggcggtgtgtatcagccctgtttgtgttacagctttttcagtcccacctttcagtggttcccaagttcttgtcccatatccaggaagaatgtggtacacagacaactggagggtaaggcagtgaggagctttattgagcaacagaacaattctcaggagacctgaagtgggtagctcctttctgcaggcaggtcatcccaacaagtgggtagctccttcctgcttctcacttcatagtcctgatgtctgtctgagtctaggggtttttatgggcccagaaggaagggagtgcatgctgattggttcatggatggccatgggtggctgggaaaaagcaccataaattctgactccaggcagtggactccacccggaactggcagcccagcccccaggcttcaggtcatccctggcttgaaggtagttagggacctgcccctttccacccaggaacctgtttcccttccaccatcaacatgccatccatggtacctgggctgttcatgctgagttggacctgcagacctgtgcagagctgccctcagccatcgtcctccctcctgtgctcactggtgctcaaagtccagaaggagctgaggaggcagaagctgtcatgtcagcactgcctccagcacatgcatacctggctgggcacaacagtgcccggactcggctacaactttgctttgcactggagtggacaccaggagcagggagagggtaggaagcagaagcaggcacttctgagcctgcaggggcagagagggtttccagggccccgagagcacagtgatgcctgggtctggagctgcggctgggtgactgcagttgtgccccagagcacaggactcctgccccgtggacttggtagagagtggggctccccccattcccagccccctcccagccccacctggctccatggagcacatggccccagccacacctcccctgctgcagccagcatcttcacagcaactgctccagacaggctgccactgttatcaacatcatacttaaacatgaaaagtggaacacttttcctgctagatcagggacaatacaagaatgcccattcttataactttttttttttttggtgtcttgctctgtcgccaggctggagtgcagtggcatgatctcagctcactgcaacctccgtcttctgggttcaagtgattctcctgcctcagcctcccgagtagctgggactacaggcacacaccaccatacccagctaattttgttgtatttttaggagagacaggttttcaccatgttggccaggatggtctcgatctcttgaccttgtgatctgcttgccttgtcctccgaaagtgctggggttacaggcgtgagccaccgccccggcacttctttctaacatagtactggatgtcctaaccagcacagttaggcaaaagaaagaaagaaaaggtatccacattggaaagaaaaaagtaaaattgtctctatttagtaataacatcatcttatatatagaaaatcctaaagacttagccaaaaaagtattggaaaaggtaaacaagtctagtaatgttgaaagatacaacatcaacatacaaagatcagtttcatttctatacactaatgaaaaactatctgaaaaagattaagaaaacaattccaatagcaacaaaaaagtacttagatataaatttaaccagagatgaaagacctggttaaaattatggaaaattataaaacactgattaaagaaattgaagaaaacacaagcaaatggaaaactatcctgtgttcataattggaagaattaatattgttttgatgtccttgactagcagagctgccgcttgccgtagtgtgctctgcaggaattgtggacgaacacagctgaagcttgccactggccactccatcccctcaaccagtgaccctgaccacttgattggtggagctgctgcctgccacatgtgactccagtgatctaaggacttgtggagtcacatgtgaccagaccaccagtgagccgaaactttcaactgtcagaggtgctgtacaccacacatgttccccaggaattgggaattagcctgcccagcatctgctcccaccagaaataccaccccctggaacagtggaggcaccacacactgcctgcatcccccagggttccaaggactggcgcactcagcacctgctgccatgacttcatatccttgattggcagagtgactacatgctgcacgcagccccccaggagtctcaggaacagcccatttggtgtccaccactgatggtggccatatctcatttacttgcagagctgctgcatgctacgtgcatcgtctaggactccaggtactggcccactcagcacctggcacctctagtaaccttgcctcctcgactggtacacccctgggaccaagtgaccagtggagctgtcatgtttggtgtgcactgcccttgcctaaaaaccagcctagctggtggccccagctccctgcaaagctgtgccattgcctccaaaactacacacagcctacaacattgacacacttgaaggtacttccaatgttgattacagctgaagcagttacatggaaattattaatataatacagcacccacgtatccaaccaacaccataggactcatctacaggaaaacatctttgcctataaaagtttccacctcagggaactagaaaaataaaaaaaagaagccccaagttgaaaatgtttgaaataacaaaaattagagcagaaatagagagtagaaaaacagaagaaaacatcaacaaaactaacaggtggtttatatataatgttattccataaaattggaagaggttattgttccaccaaatttgcagatatcaatgtaggaacccaagaaacatgaaaatccaaggaaatatgacacctccaaaggaacacagtaattcttcagtaacagactccaaggaaaataaaatctatgaatgcctgaaaaggagttcaaaataatgatcttaagaacacttagtgagacacaagagactagaaatggagaatttaacaaaatcaggaaaacaatttttcatctaaatgaaatactttttaaaagcccctttccccatttaaaaaaaaaaagaaatattcaacagagagacagatactacaaaacagagctaaacaggaatcttggagctaaggaattcaatgaatgaaataaaaacattgccatttgatggattactatagtgataaaatttgattcctttcaaatttatacaggagataaatcagaagaaagaatttctgaacttgaagacaggtattttgaaataacccagtctgatgaaaaaaagaaagagaaaaaagaatgaagaaagtatacaggacttatgaaataccattaagtgaaaaaattttcatattatgtgagtttcagaagaagagatgagagatggtgtaaataacctatttaataaaataatagctgaaaactttgcaagtcctggaagagatgtggacatccagttccaggaagcttaaaagtttccaaaatattcaacacaaaaaggtcctctacatggcacattttagtcaaattgtcaaaaggacaaacagagaattctaaaatgagcaagataaaagtgtcatgctacgtacaagagaattcccatcagactaacaacagatttctttccttcttccttccttccttccttcctttctttcttttttttttttttgatggagtcttgctctgtcgccaggctggaatccactggcacgatttcggctcactgcagcctctgactccctagttcaagtgattatcctgccttagcctctcgagtagctgggattacaggcacgcaccaccacacccagctaatttttgtatttttagtagagacggggtttcgccatgttggtcaggatggtaacagcagatttcttaacagaaatcttacaggccaagagagaaagggatactatgttcaaagtgctggaagggaaaaaaagccaactaagacatgatggccagcaaagatattcttcggaaataaagaagaaaaagatattttttagataagcaaaactgagggaatttatcaccactagatcagtcttacaagaaatgctcaagggagtcctatgtctggaagggaaaggatgataactaccatatgaaaacacctgaaggtagaaaactcactggaagaatagatatgaaaatgagaaagagaaaggaatcaaattttatcactatagtaatccatcaaacggcaaagggaaatgataagagaggaagaatcaaacttggatatacaaaataatgaacaaaaagttaacaaaatgacaggaataagtcctcactcatcaacaatacccttgaatgtaaatagtttaaattccctaattaaaatatatagattggctgaatgaatgaatgaatgaataaatgaaaaaagatcccattatatggtgcccagaagaaactcacttcacttgtaaagacacacaaagactgaaattgagggatgatgaatggtattccacacaaaaggaaaaaaaaacaagcaagaatagctatacttatattagataagatagattttaagtcaaaaactgtaaaaagggacaaagaagattattatttaatgataaaggggtcaattcaacaagaggatatagcaattgtaaatatatatgaacccaatacaaaagcaccaaaattcataaagcaaatattactagatctaaagggaaaggtagatcccaatacattaattaatgtaatgtctagctgaactgtctagctgttgaagctgggggcttcaacaccccacactcaccattggacagatcatctagacagaaaatcaacaaagtaacattggatttattgtaccctatacaccaaatgaacctagcagatatttacataacattttatccacaagctgcagaatacacattcttctcatcagcacatggaatattctgcaggatacattttatgttaggccacaaaacaacctcaacaattttttttaaaataaaaactatatcaaatatattttcagggcacaatagaataaaacaagaaatcaataacaagaacactggaaattgtacaaatacatggaaattaaacgacattcttctgaacaaccattggcttaatgcagaaattaaaaacaaagttaaagaactccttaaaacaaatgaaaatataaatacaacataccagctgggcacagtggctcatgcctgtaatcccagcactttgggaggctgaggtgggcagatcacgaggtcaaggggtcaagaccagcctgaccaacatggtgaagcaccatctctactaaaaatacaaaaaattggctgagcatggtggcactaatcccagctactcgggaggctgaggcaggagaatctcttgaaccagggaggcagaggttgcagtgagctgagatcatgctgctgcacttcagcctgggcgacagagcaagacttcatctcagaggaaaaaaaaaaaaaaagaaacacaagataccaaaacatatgggatatagtaaaagcagtactaggaggtaagtttatagcaataaatgcctacatcataaaaagtataaatatttcaagtagaaaaaactccaaacaattagcctcaagaaactagaagggcaagaagaaacaaagcccaaattttgtagaaggaaataaataataaatatcagaggagaaataaatgaaataaagaccaaaattataagacaaaagaccaacaaaataagagtttgtgttttgaaaagataaaattgacaaacccttagctggaataactatgaaaaaaagagagaagatccaaataaagaaaatcagaaaccaaaaggaggcattacaactgataccagagaaatagagaaatacaaaggatcattggagactattaagaactatatgccacggggcacaattgttcatgcctgtaatctcagcactttgggaggccaaggcaggcaaatcacttgaggtcaggagctcgaaaccagcctggccaacatggtggtgaaaccctgtctctacaaaaaaacaacaataacaacaaaaaaaacccataaaaattagctgggcttggtggcatgcacctgtagccccaactactcaggaggctgaggctgagaatcattgaacctgggaggcagaggctgcagtgagccgagattgagatgcagcctgggaaacacagcaagaagaaagaggtggaagggagggagggaggaaggaagggaggaaggaaggaaggaaggaaggaaggaaggaaggaaggaaggagagaaagaaagaactagtatatgccaacaagttggaaaatgtaaaagaagtagataaactcataaacacatggaacatactaaaatagagtcaggaaaaactagaaaacctaatcagactaataatgagtaacaagagtgaatcagcagtaggaagtatcccaacaaacaaaagcccaaaacaagatgacttcactgctggattctattaaacttttaaagaactaacaccttctcttcttaaagtattacaaaaagttgaaggggtgggaattcttccaaactcattccatgaggacagtattatcctgatgccaaaatcagaaaagaatacaacaaaaaggagaatgctacaggccaatattcattatgaacatagatgcaaaaattctcaacaaaatactagcaatccaaatccaatagcatatcaaaaagaatatacaccatgattaagtgggattgattctagggatgcaaggatggttcaacatatggaaatcaataaatttgatatatcacatcaacagaatgaagaccaaaaagtatatgatcatctcaatagacattaaaaaatatttgatgaaattcaacatcctgcatgatataaactctcaacagtttagatgtagaagaaatgtacctcaacacaatcaaggtcacatatgacaaactcacagctaacatcatacagaatggggaaaagttgaaagcttttcaataagaactggaacaagacaaggatgcccacttttactactcttattcaacaaagtactggaagtcctagccggagcaatcaggcaagagcaaaaaataaatggcatctaaattggaaaggagaaagtctaattgtccctgtttgcagacaacatgatctttatataaaaaaactaaagattccatcaaaaaaacctcttagaactgataaacaaattcagtaatgttgcaggatacaaaatcaacatataaattcagtagtgtttctacacaccaataacaaactagttgaaaaagaatcaagaaagcagtatcatttacaatagctacaacaaaataaaataccaaggaataagtttaaccaaggaggtgaagatctatacaataaaaactacaaaacattgatgaaaagaactgaagggaacacaaacaaatgaaaagataccccatgttcctgatgtaagagaattaagattggtaaaatgaccacactacccaaagtgatctacagagtcaatgcaatccttatcaaaataccaatgacattctttaaagaaataaaaaccaaaatcctaaaattcatatggagccacaaaagactccaaacagccaaaacattactgaataaaagaacaaagctggaagtatcacactatggagcttcaaaatacactacaaaagcatgctagccaagacagcgtggtactagcataaaagcagacacacagaagaatgagacagaatacaaaacccagatataaatccacatatttacagtcagctcacttttgagaaaggtgccaagaatatatattagagaaaagagtctcttcaaaaaatagtgctgcatttgctagtatcaatatgcagaagaatgaactaacccctatctctcaccatatataaaaataaactcttgatgaattaaaggctaaaatgtaaaacctgaaactataaagctactagaagaaaacataggaaaaatgcttcaggacattggactgggcaataatttttttttatgtgatttcaaaaccacagacaataaaagcagaaacagacaagtgtgattatatcaaactgaaaagcttttgcacaacaaaggaaataattaacagagtgaagaggtaacttacagaatgggagaaaatatttgcaaactatacatctgactaggtattcatatccaggatataaggaactcaaacaactcaagagtgaaaaaacccaaataatccaatcacaaaagggaagatagacttttttttttttttttttttttgaggcagagtctcgctctgtcgcccagactgcagtgcaatggcgcaatcttggctcactacaacctcagcttcctgggttcaagtgattctcctgcctcagcctcccgagtagctgggattacagacaccatccaccacacccagctaatttttatatttttagtagagacggggtttcaccaggttggccaggctggtctctaactcctgacctcaggtgatccatccagcctcccaaagtgctgggattacaggcatgagccaccgtgcctggccaggatgatagaccttatatacatttcttaaaagaaaacatacaaatgaacaacagatatataaaaatctgttcagtatcactagtcatcagggaaatgcaaatcaaaactacaatgagataaaacattactcaagttaaaattgctattatcaaaaagacaaaagataacaattgttgatgtggagaagaggaacacttacacaccattggtgggattttcaattagtgtgttcattatggaaaacactatggagatttctcaaaacattaaaaacaaaactaccatagatccagcaatcaaagtactgagtatacccaaaagaaagaaaatcaacatgttgaagaaatctgcactcctatgtttatttcagcactattcacaatagctaagatatggaatcaacctaagtgtttattaacaaattaatgaaaagcaaatatgatgtatatacaaaatagaatattattcagtaataaaaagagtgaaatcctattatttgcaacaacatggatgaacttagaagacactacgttaagttacattaaaccatacatgatctcacccataagtggaatccaataaatggatctcatagaggtacagaatctagaagacattaagtaaattaagccagacacagaaatacaaatatcacatgatctcacccacatatggaatccaaaaagtttatctcatagaagtagagaagtaggggttaccagagactggtggagctggggatagggtagagggaggaatggagaaagactggccaatgcatacaaagttacaattagataggaagaaaatgttctggtgtcctgttgcatagcaaagtgactatagttaacaagaatgtatagtatatttcagaatagctagaagagaggattttgaatgttctcaccacaaagacacgacaagtgtttgaggtgatggaaatgatcattacacaatgtatacatgtatcacgacatcacattgtaccacataaatatgtacagttattatgaggcaattaaaattcttttaaaaagctgatctcatagaagtagaaagtggaatagtggttactagaggctggtaagggtagagggattgcaggggatgaggagaggttgatcaggtacaaaattatatttaaatagcagcaataagttccagtcttctattgcacagtagggtaactataattaccaataacatattacatatctcaaaatagctagaaaagaggattttgaatgttctcaccttaaatgatcaatgttttaggtgataccttaatttgatcattacatattgtacacatatatcaaagcaccattttgtaccctgtaaatatgaacaattattacatcaatacaaagtaaaataaaacttaaaaaactgaacacaaataaaggaaatatattccatgttcagggattggaaggattagcattgttaaaatgtttatactacccaaagctatttacagattcaatacagtctctctcaagattctaacgtcacttttcacagataaagaaaaaaggaatccttaaattcatatggaatcacaaaagatctcaaatagccaaagcaatcttgagcaaaaataacaaagttagagtcacaatactctgatttcaaaatataaagtgattataattaaaacgtcctggggctggcacaaaagcggacacatcactcaatggaacaggatggaaagtttggaagtacgcccatgtgtttatgaacaattgatttttgaaaaaggtgccaagaacacaggatgaagaaaggacagtctcttcaataaatgatattgaaacaagtggatatccacatgcacatgtgtgaaattgaacccttatctcacaccatgtacaaaaacgaactcagattaaaaagttaaacataagacctgcaactataaaactgctagaagaaaatatatgggcaaagctccatgacattgatcttggcaataatttttttgaatatgacataaaaagcacagacaaaaaagcaaaaatagacaaatgggattacatcaaactaaaaagcttctgtacagcaaagaaaacagttaacaaggtgaaggactacccacagagtgagagaaaatatttgcaaaccaaacagctgatagagggttaataaccaaaatatataagaaattcaaacagctcaatagaaagaaaacaaataacctgatcttaaaaaaggggaaaggacctgaacaaacatttctcaaaattacatttaagtggacaacagggagagtgtaggcttgcgctaactctcttctttcacctagttgcactcctgagagcaagatgggtcaccagcagctgtactggagccactcatgaaaattcggtcagggttcttgctcttgtcgagtctgatccggaaatatggcctcaatatgtgctggcagtgtttccatcagcacgcaaaggacatatgtttcattaagttgaactaagtgctcttccttgaatggattatccaaggcatctacgcaatgaaaaaccatgatagctctttgtacataaaataaacattaataaataaataaataaataaataaataaatggacaacaggtacatgaagaaatgctcagcatctctaatcattgtggaaacgcaaattaaaccacaatgagatatcaccttacacctctttgaatggctattatcaaaaagattaaagataagtgttggcaaggatgctgagaaaaggaactcatacattattggtgggaatgtaaattagtatggcaattatggaaaactgtatggagttttcttaaaaaactaagaatagaactactctatgattcagcagtcctacttgtgggaatatatgaaaatggattgtaatcaatatgttgatggaatagctgtattactcacaattgctaaattcagtctaagtgtccatcattcagatgaatggataaagaaaatgtgatctataaatacaatggaatacaatatttagcctttaaaaaaaggatggacattttgtcgtttgcaactccgaggataaacctgaaggacattatgctaagtgaaataagccaagcacagaaagatgaatctcttgtgatctgatatatgtcaaagctaaaaaagttgaactcataacaatagagagtagaatgttaccagaggctggggcagagggcaagagagaatggggagttgttggtcaaagggtgcaaagattgagatagacaagaggaatatgttttgaagtctactgaagaacagggtgactgtagttaacaataatatattgtatatttcagaataacagaaagaataaaatttaaatgtctcatcataaaaatgataagtaagggagatgatggatgtcttaattagcttgatttaatcattccacattgtaggcatgtatcaaagagtcacaccgtacccattaatatgtatgtgatttgtcaatttaaataatagtaataaaaggagggaagagatagtttttcagacaagatgcaaatattttaagacatcagttctctctgaattgatctatagattcaatacaattccattcaaaatctcagcagaattttcttagaacttgacaagtcaatacaaaaatttatgtcgcagagcaaagttgccaaggcacaactgaataagaagtgaggaaacttagtctagtttataccaagacatatcccggaactgtggtgattaagccactcaaaattattggcacaaaagtggacaagtagacaaatgacacagagcagagagcccagaaacaaatccaaacctaaacagaaagcttattgggtcagaggtgatgctgcacgtatcagtgtgtaaaggaatgtccattcaataaatgttggcacagtcgttatctgttgagaagaaaattaaatagaaccactacctcattttataacaaaagtacaatcaaagtattaagcctataggagaatttatagaaacctatttcttccattgtggggaacaaggtgactccttaaagaagaattgaattgtgtcttttgttcaccaataactaaaatgtctgtgggattgtttttcagatacctttttcgagcctatatcgtggcacctggctaccaaagtactgggaatactctgctgtggcctattttttggcattgttggactgaagattttcttctccaaattccagtgtaagcgagagagagaagcatgggccggtgccttattcatggttccagcagggacaggatcagagatgctcccacatccagctgcttctcttcttctagtcctagcctccaggggcccaggcccaaaaaagtaatcatccttctctagggtattctaacatctcttcctctggaaatatcaactacgacagccccttgctacttcatttaggtcaaataataaggggatgaatgattttcagtacctatagagagagcttggataattttccatgaacaccaccaagactcctattaaaaagttttaatgtggtgaacaaattcataaaggaggaagcaaaagtgactgacaataagataaaattatattcagtctcaataagacttttcacccccaaaaccaatttcctcctccttgggagtgacacttccccttgggggtgaggccacccccgcctcccctcccagctgccttctcccatctccatccccacctccacagcatcccagctgttgtccctctccttagcatgcaccttcctgatctcttgctccaccccagagagccacactccgtgcaggagctggggagacgagcacatataagtgtcctaggagaggccctgcccttcacacctgcagctcgtcccacctgtgcaaggagccagcgtcgtgtttgtgccttgtacactcctgtgtccaccactgaatatactgtttctgtttcagggaaaatccaggcggaactgggtaagtatgtgtcatgtcctgagcctcccacacatggttctcccgggtccctccctgatccacagtttgagcctctggacgaccctggctgcaggctggacaggaagcaccggcaggtggaggagagcagctgctcgctctctccatccactgctcatgagttacccctcggacatctggagggcttaggataggccccggggcctggaagtccccacaaattgtctgtgcctgttgcccgttggtttgctgtgtgtgtggtgggggaaggtgttgatcatgagctctgagggtgtctgggccacagtgaggaacctgagaaaaatttgtgggtgatcctcgacctcccctggcctgatgctttgagactttatccagttctgtatcaaccactaaatagtctgctttttgttttgtgggaactccaggataaactgggtgagagtgttaccactcgcagggattccctcccacgccctccctgggcccccgctctgtgacgtcagcctcttacatgttttttgtttttgtttttgtttttcagactggagaagaaagcacggacaggcaggtaaaagaaaatattcctcttcacacatttatgactcctttccaagtctctcgtttatggatttttatatcctgaggcccgtgggtccctgcagagccaagcttgtgatgggaactctgaaattgcagattctgggggaggtgcattttgtagagaagccccatagccttcttcggatctctggagggtccacaacactcaaaaagggtcccaatccttggtctttcccttctccctgcgccctgtttcccacgtgagcactgaactgcctgctctgtctgcttgctttcagaattgagagacgcccggaaacacgcaggtaccaacgcctgagagggtgacagtgggacagaatctcaggtggacatgagagggggaactgaacagggacagatacgggaacacagagtgatgctgagacccatcctgcctgcagatggagaaactggatgcttgatcgcccccaagggttcagtgcccccagacacacttctttcccttggtctagaaggggagaagacaggggctgggtaaacgggagacgggggggtctttggcacagtttcagggaattgagggcactagtgactggtcaggggtctgagctgaggggaaggaagtaaagtcaggcagaaaattctgagtgggaggaagttagatagtggggtccctccagctcttatgaatcaaatagttttatgtatgaagggacagtggcagggttgggtgatatgccgagattgggacgtcatattgagacatatctagacattgatgagtcctccaggctgcactggtgatgagaggacctgaaaggcagtgtctgcgggaggctcaggtccggggcctcacctatgccacccagagccagtctgcagtgggagggtcgacctcttgctccagcccagatttcgtcttcagtaactcatgcttcctctctcccccaccgcaccccagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcagcagccggccaaggtggcttccagatgaagggggactggcctgtccacatgggagtcaggtgtcatggctgccctgagctgggagggaagaaggctgacattacatttagtttgctctcactccatctggctaagtgatcttgaaataccacctctcaggtgaagaaccgtcaggaattcccatctcacaggctgtggtgtagattaagtagacaaggaatgtgaataatgcttagatcttattgatgacagagtgtatcctaatggtttgttcattatattacactttcagtaaggtctttgcttgtttatttcacatgaatttattgttccctacttcaaatcacccatgaaacaggcacctgctctgtgccagagccagagggaaggtggcacttccattgcattctatagagcccgcattactttcataccaaaaccagacaaggacattacaagaaaagaaaggaaaactacacgtccatatcccccatgaacttagacacaaatattctaattaaaattttagcaaactgaatccagcaatacattcaaagaataatacatcactactaaatatgttttttctcatatgtggcttaatattcaaatatcaaccagtttaattaaccacattaacaaactgaaaaagaaaactatacgatcatttcaatagatgcaggaaaaaattacatctgtgagcaaagaagctacacagatgacaggcacatgaaaagatactcaacatcatagtaattgagacaattcaaattaaaacaatgagataccattcctacctattggagtggtaataaaattacacagaatgatcatacccagtgttggccacaatgtgcagaaactgaaactcacaccctgctgataggaatgtaaaagagtgtaaaaatgtaaaaactattttggaaaactgtatggcagtttctttaaaagtaaacagtcacctaacgtatggtccagccatcccactcttaagtattcaccaagagaaaaggaactgcatgtcttgacaaagccttgtacctcaatattcatagaagcctcattcagaataggtgaaaggtggagacagcccagatactcacaacagatgagcagataaacaaaccgtggtgcatccacgcatcaggcgctccatgacagtcaaaaatcaactcttcgggcaggcagtgaagggtcgtcacacagcagctgtgggtgcagaaggtggtggattccatggtggagagtctggacagagagaacatccagaagatccaggtgagcagcccgaggcccagccaaggcgtggccagggtgaaagacaagaaaggcgaaggctcctggccttcgaacctcatcctttgagtgctatgcccacatttaaatatacatgctttattttaaagagcagttctaggttcatagaaaagtcacgtggaaagtacaaagagttcccatataccctctgcccacacaggtgcatagctctccctactgtccacatcccaccaagatggaacattgtaactatcaataaacctatgttaacacctcattatcacccaaagtctgcagctgacattagcgttcactcttggtgttgtacattccatgggttttggcaaatggataatgacatggatctatcatcactgcatcacacagatgctttctttgccctaaaaatcctctgtgctctgctattattcatgcttccctcaccactaacctctggcaaccactggtctttttactatttccagagatttgccttttctggaatgtcatataattggagtcatacaatatgtggtctttttagattgttttctttcactttataatataaacagtcacatttttaaaatcacagtgatatgcctgatacactactattgctttattgattttatgtaatgtccaagtctgtaggtactcaggtacctgagtacggacagtgtcaagaggaggagagggatgtgcttcttaatgcagcatttgctgagtgagaagaggtgaccaccccaggagctgccaatgttcaatcccttctggccttagcccagggagcttgagggtgattgaagtggaaatccacagggtcttccacagtcccttctccccagtgctggtagagtgtgtcttaaagcagctgtagatggaatactacttggttaaaaagaaggaacaaactattgatacatgcaacattttggatgtatcttgtaggcggcatattcagtgaaaaaagtccatctcaccaagttcataggatatgactccatttatatgacattctcaaaatcacaaaattatagagaggaagaaaaataagtggtttccaggaattaggaaagggggagagggtgtgtgttttagtctgttttcacactgctataaagaactacctgagactgggtaacttataaagaaaagaggtttaattgactcagttctgcacggctggggaggcccaggaaacttacaatcatggcaaaaggcaaaggggaagcaaagcacgtcctacatggtggcaggagagaaagagaacaacgtgggaactgtcacacgcttttaaaccgtcagatgtcgtggaactcactccctatcatgagaacagcatgggggaaccacacccatgacccaatcaccttacaccaggtccctcttttgacacatggggattataatttgacatgagatttgggtggggacaagagtcacaccatatcagagtgatttatagatgcacattgagggaggtcttcaatagtgatggaatagtatgttttttccttgagacagggtctcggtctatctcccaggctgcagtgcagtggtttaagcatagctcactgcagcctcgaatttccaggcttgaacgatcttctcacctcatcctcctgagtagctgggaccacaggcatgtgccaccatgccctgctacttttttgacttttatttttagtagagatgaggtttccctgtgttgcccaggctggtctcaaactcttgggctcaagggatcctcctgcctcagcctcccaaagtgctaggattacaggtttgagccactgtgcttgttctggaacagtatcttgtttatgatggtggttacttgaatttatatatctaataaaattgcacagaaccacatgcatgtgcacacacacacacacacacacacacacacacaaatgaatgcatgtaaaaactgctaacatgtgaatcaggcctggagtctagttaacatatttatatcaatatcaatctcctggtttcaatattgtgccatagcaaagctacataagatgttgccattgccttaattttaaaaaattgttaccattggagaaagcttggtgaagggtactcaagactcaacaatttttgcaatttcctgggagtttatatgactgtttcaaaataaaacaaaaatttgtaaagcagctttaaaaaaacaacatttattttaaaatgaagttgggttgtcgaaataaataaatgtgtgtgaaacagagtttcagagattcaactggtatcagctcacatcaaatgacaatgaaacagaagacttaaaaaaatttctgtagctttgagtatcagaacaactatcttcaacaaatcaaaattgaatgatgccattagctgtgccatccaaagtaaataaggactaaaatcatgaataagaaaacttggaataataggtgataaagctaacattaatgtaacatggtagtccgactagaaacaataagtgccaatataacgaattcccctgcaaaacatccccaccaccaagttagttttcattataaagatgattaaaacaaactaaagcagccacagacaggaacaccgggcctgcctcctggtgcagccgtctgagcttcccaccttaggacagcagtgggaagcaggatggtggggcccaagtcaggagctaagtccccctactgtgcctggggaaggatgcaaggctcctgaggcacctcaggagaggaagcagagagggttgtagtcgatgagctgagtctggaggccagagggagccgagggtctaggagcacgtggtgagtggcagagatgctggtaggctccctgtgtgtttttcagggagtaataaatacaagcccagaaactaccaggagccaggcattagagatatgaggatggactgctgtgaactgtctaggaacaaaatagctgaaagggcactgtggaagaaggtgtcagaaaattaacttctgaaaggaaaggagagagggctaggaaggccttgggcagccaagttcatacagagacgtgtgtgtgtgcatgtgtgtgtgtgtgtgtgcgcgtgatgtaaggagaaaggaggaaagaagtgggggtaaaagtgaaattttctgagctattctgtggtttttttctctgacatgaccaaaataggaagaaaaagaaaataaaactaaagaaaaaaacaaaaaaaaattcacacacaaaaaaggagcagcaatgtcactcacacatgaaacctgacttcacatcccagatctgcttgggatgcagaagtccatttgactgttaaaaatgtatttttatcaaagtgatgcaaactaatatttaaaggagtttttaggtccggtgcggtggctcacatctataatcctagaactttgggaggccaggtgggtggactgcttgagcccaggggttcgagaccagcctgggcaacattgcaaaaccctgtctctacaaaaaatacaaaaaattagccaggtgggtggtgcatgcctgtggacccagctactcgtgaggctgacaggaggattgtttgagcctgggaggttgaggctgcagtgagctgagatcacgtcactgcactccagcctgggtgacaaagagagaccctgtctcaaaacaaactaacaaacagaatccccccccaccacaaaaaaccaaaccaaaaccatgatttttaaaagcattgtaataaaaagcaatagtaccccaatgccttactactgtgtccctttccaacccaccccagtgttgtacccacagggaaaactttatggcttctctttttggttgtttttccttatagctaagttacttgtttcttcttctggcattttattttatttatttatttatttaattttttttttcgagtcagagtctcgctctgtcccccaagctggagtgcagtggtgcgatctcggctcactgcaacctccacctcccgggttcaagtgattctcctgtctcagcctcctgaggagctgggactacaggcacccgccaccacacccagctaggctaatttttgtatttttcgtagagacaggttttcaccatgttggccaggctggtctcaaactcctgacctcaggtgatctgcccacctcagcctccctaaaagggctgggattacaggcatgacccactgcgctcagctattttgttttatttttaattgacaaaaattgtatatatctgtcgtgtgtaagatgttgtattgaaatatgtatgcagtgtggaatggctatagacagctaatcaacatatgcattacatcacatacttatcttttttgtgatgagaacacatgaaatctattgtttcagtaattttcaagaatacaatacattgttactaactatagtcaccaggttgtataatagatctcttaaacgaattcctcctaactcaaactttttaccttttgaccaacatttccccaaacttcccacatactcagcccctggagaccaccatgctattttttacttctgttagttcaacttttctagactctacatatacataagatcatgcagtatttctttttctgggcctggcttatttatcttaatataatgtcctccaggtttatctacgttgtcacaaataacaggattttcttcttttttaaaggttcatactacttcattgtgtatctatatacatacatagtgtctacccacacataaatacacaaacacaatgttgaatattttcttcggagaaatgtttatgtatatatacaatattttctttttctttccttttttttttttttttgagacagactttcactcttgtcggccaggctggagtacaatggcgcgatctcggctcaccgcaacctccgcctcctgagttcaagcgattctcctgcctcagcctcccaagtagctgggataacaggcatgggccaccacgcctggctgatgcctgtaatcccagcactttgggaggccaaggcaggtggatcatctgaggccaggagttcgagaccagcctggccaacatggtgaaaccccatctctactaaaaatacaatattttctttatctctttatctgtttacgggcgcctgggttgattccatttcttggctgttgtggataatgctgcatggcagtgcagatatctcttcaatataccaatttaaattcctttgcatatacacccaggagtaggattactgaatcataaggtggtcatatttttaattttggggggaatctccatgctgttttcgataatgactgtactaatttacattcccaccaacagggtgcaagaactctcttttctttacatccttcacacctatctttcatcactttgataatcgctattcaaacaggtgtgagtcaacatcccactgtgattttagtttgcatttctcccatgactggtgatgctgagcattttttcatatatgtttcaaacatttaaatggtttctttagagaaatgtctattccagttctttgcccattttttaatcgtcttttttttttttttttgctgtttagtcaaattcttatatattctggtcagaaattccctattggatgtctagtttgcgaatattttctcccattgtgtgggctgtcttttcactctgttgtttcctttgttatgcagaaactttttgaattgatataatctcatttatctatttttgcttttgttgcctgtgcttttgaggttttacacaaacaaaccattgcccagatcaatgtcctgaagcatttccccagtattttcttctagtaattttatagttccaggtcttatatttaagtttttgatccattttaatttgattttttatatggtgagagatggggcatccagttcattcttctgcatatggatatctatttttcccagcactatttattgaagagactgtcctttccccaacatatgttcttgctgcctttgttgaaagtgagttgactgtaaatgtatggatttgttttgggattctctattttgttctgttggtctgtgtgcctatttttatgtcactaccacgctgtttggttaccaaagctttgcagtaaatttggaagtcaggtagtgtgatatctccagctttgttctttttgcttaggattgctttggctatgtgaggtcttttgtagttccatacaaattttaggactctttttctatttctgtgaagaatgtcactggcattttgatatggattatattgagtctatagattatttttggtagtatgaatattttaacaataataattcttccaatccataaacattagaaatctttccatttgtttgtgtcctcaaacttcttttatcagttttttatagttttcattttagaactttttcacttctttggctaaatttattccttgctatttaaatttttggtagctattgcaaatgagattgctttcttgatttctcttccagattgttcactatcggcatctataaatgctactgatgtttgtatgttgattttgtatcttaaaactttactcaattcatttatcagtgccaagagtttttttgctggagtgtttcagtttttctaattataagattatgtcatttgcaaacaagaacgatttaacttcttcctttccaatttgaatggactttatttctttccctcgcctaattgctcttgctagggcttccagtactatgctgaataaaagtattgaaagtggacacctctgtcttcttctagctcttagaagaaaggctttcaggtttttctcctaataagtatgatgttagctgtggatttgtcatacatggtctttattgtgttgaggtattttctttgtatatccagtttcatcatgaaggcacgttgaatcatgtaaaatgctacttctgagtctattgagatgatcatatggtttttgtccttcattctgttcatgtggtgtatcccatttattgatttgtgtgtattaatccatccttgcatccctgggataaattccacttgatcatggtgtgttatctttttgctgtgttgttggaattggtttgctagtatttttgcatctgtgttcattcaagatattggcttgtagttttctttttttgttgtgtctttgtctagctttggtatgagggcaatgctggccacatagaatgacttagggagagatcctgcctctacaacttttgcaaatagtttgagtagaaatggtattaattcttcttttaaagtttggtagaatttgtcagtaaagccatcagtgatgtaacctgtccccaagtctcccagcaatgggtaccagcaccagctctgatgagggtggcaggggagtaacgtagactctgagattcctttgttataaataggcttagtatattggctttctcaaatgttggttacggtagtaatgaactgttcacctggacagactaggacccactggttagtcaggacactgtgggaaatggtgatagctgaggtcacacacaagtgttcttcttcctgggtgctctgttactcctcctggagctgctgtaatggactgactgtgtcagttggcctctagcttggaggtgttgcttggaaaagagcaccagctgcggtagtagcagtgggatttatacttgccttatgttacccagggggtactgtggtgtctcaggcaatgggaggggccataaaattcccaaaagtttccgtcctttgtgttaagctaccagggtaggtggaggggcaaaaccaggtggaggctgggtcaggcgggtccacgtgctggctctccacatgcaaggcaaacaatggctcttgtgggggttgagggtggttctcttgccactaggacaatgttccagggaggggtgcagctgcctctattgcacagaagagtttacacagggagtggggagtagcaggtggcataagccccacacagtcccacgtacttggcaaggcaaacctcacgcccagagtgttccactagcagcggctagctaagttccaggcagtttgtgctcagaactcaaaactgctccaggccataagcctttctggcagagacagcaactgcggcatttaggccatgcccttcccagtctgccagcaaagccagggtgcccagcttctgcactcatggatgcagcacgcttttcactcacctcccacttctggcaaagaaagttcatccccactcgagagaatatcatgaattttagttagaagcttttcttaacctgtgactgctgcctgaataagctggccgacttctgtgaggtcccctgggaggcaggatcaggaatggcttccttcgtccacactggaggctgggaatgcatgcaaggctcttgtgctggtgctcctaattttttgttccccactactccctaaaccagtttcagggctggatagaattaaggccttcccctccggcctgtattgtcaggttcccacgtcgcagtgtatatcttgggggcagtttatcccccctcacactttgaggacttacagttttctgcctgactcattgtgtaggctgcagcctgccacttctttcaaagagtttgtggtttctttcagttttcctgttaagttcttgcctgcttactagaaaaaaattcacactgtgtatgtctagacactattttgtctttccaagtaggagaggcatgctaacaatgcctctaatccaccatcttgggaaaaaaccttttaattgtgggatttaatatgtttactttcaaggctgttattgataactacttcttattattttgttaattgccttttaattgttttgtatatccttgttcctttcttattctcttattgcttatctttgcaatttgatggctttctatagtgatgacatttgattcctctctttttctcatttgtgtatctgcttcttccagtgagtttcatacttttgtgtgttttcgtgatgggagatatcatcctttcacttctagatgcaggaagtgcatttaagcatttctcaaaggcctgtctagtgataatgaatttgctcagattttgtttttctgggaaagactttattcctctttcatttctgaaggataactttgctaggtatcgtatttttgcctgacagttttttctttttctttcagggctttgaatatattatcccattctctcttggcctagaggtttttgctgagaaatatgctgttaatctgatggagattcatgtgacttgatgctttcctcttgacatttttacaattctttctttgtctttgacttttgacaatttgagtataatgtgcctccgagaagacattttgggttgtgtctatttgggattctttgatcttcccgcatatgaatgtcttcatctcttcgaagacatgagaacttttcagctattatctttaaatcggttttctatgccttttgccatgtttgtaccttctggaactcccaacatttgaggttttgttcacttgattgtgtcccatatgtcatataggatttcttcactctttgattttttttctgagttatttcattttttttcttgaaagattaactgtttaactataaagaaataactaaaaattaaaaatagcttataaactttatttatataattactgaagggaacagagtaactgtttgtggtggtggacccaggaaggcggctctcaagttctggggagtgcgtatttccattctctatgttctcagcacagactgtctgatgtgcaggaatgcctgcttccaggtttagagtgctccatgggttcagatttactgcacatctcggtccagctaatgctctgatgctgcagacttctgggtggatatgagaggatgctagtgggaccccagggatgtggagatgcaggggctattaagccatggtgcagaatgttgtcttgtattgggtctgttctcaaaatgatgtcatgctgcagttgattgggtcctggggatgtaatattgcatgaactccttccgtggaacagtgcagtcacatggaccccaggcaaatccctatactactcagggcctttgagggctgaggggctttcctgtagcatgtactacaggactctggcatgtggactgctgaggatctcttacttgccttttcctccgatgggagtccctcctggctctgcgctaatctgactggatgcctcacttccccctctgtgctgccatctcaagctttcatgcctcagagtgtttcagttgcttcccttctggattccagcatttcttccctacacgctatattcaatgtgtgattacctacatgctgttttggttcttccttgtggaggaggtgagtgctgggtgcctgtaggcagccatcttggtctttcctcagcttttacttgtttcaatttctccttcatttccaaaagacaattttccttgtacattattcttggtaggtagtttttgttgttgtttgtttgcttgcttcagcactttgactgtatcatcccacattctctgttgagaaatctgctaatgggtccaagcctcattcaaaccaccatatgtgttatttagttattttatcttagtttcaggattccctctttgttcttcacttattacagttgggttataataagtcttgctatatttctggtctggattgaaacttattgcagacctttgatattcttgtatctggatatctatagcttttattgtatttggaaagttttctgctgttatttctttactccttctatccctttatctttctctgctcctcacaaactcctataattcaaacatttgctcttctgataccattccataggtcttataaactttctccattccttttgtactattttcctcctctgactgtatattttcaaataaactgtcttagagttcacatattctttcttctgtttgatcaattctgctattgatactctttaaatttcattaattgtatttttcaactccagaatatctgtttgattttataaataatttaaatatctgttaaatttcttattttggtcatttattatttttatgatttcattgaatcgtttctactttcttgaagttcactgagcttccttaaaactattattttaaatattttgtcaggcagtttgtatatcctcatttttttggagtttggcactgggagtttattgtgttcctttagtggtattatatctctttagtttttcctgtttctttttgctttatgttgatgtctgcacatttgacaaagtaaagattattccagtctttgcagactggatttgtctgggaaacattttcaccagtcatctcatctagagattttagcaagggtctctgtgatggtctgaggtcagcgttgctacaagagtcctttggcaggccagcctggtgcctgagtcagcaggtgggaagaactgacttctaggtctgtgggtttggcctgaaaccttgatccccttaggtagacctattgattgagtctgtggggatggtcctagaggctgtgtctatgagggtgagcctgtatctgctggagctgcctaaggtctagatccacagggatgacccggtgctggtgtgggccttgagcctgagtctgcaggggctggataggcacaacgatggctctggcatctggatccactggaatgggcctggaacctgagcccaaaaggactggccttgttctggggctgacctggcaactgagaccagtaaaatgtccttgaagttggaatccatggtggctggcccaaagcctttgtcttcaggagtggacttagaacttcaattcatagaatccttcctggcactggagtctaatgtccctgcaccttgagtctgctggagcagactctgggtcatggagcagctgagactggtctagagcctgagaacatcctagtactgaggatggcatggagcctgaatctgcaggaactggcctggggcctaggattgtcagtgctggccttgtcactgaagccacagtagctgtcctggagcctgtgtccactggtgttggtcttcaggctaaatgtatccgtgctaagctagtggctaggtttgagatggctggcttgggtcctgaggcttcaggggctaacctgggactggatacacagggtcaggccactattcctgaagaataaatatgcaaaactcctcaacaaaatattagcaaactgaatttaacaaaactaaaaagatcatgcactgtaatcaagtgagatttatcctaggcatgcaagaatggttcaacatatgtaaatcaataaatgtgacacatcacattaacaaaacgaaggacaaacaccatatgatcatctcaatggatgcaggaaatgcactttacaaaattcaacactttcttccaccataaaaactttcaacaaattaggtatggaagaaatgtaccttatcacaatgaagaccgtatataacaagcccacatctaacaacatactcagtggtgaaaagttgaaagcttttcctcaataatcaaggacaagacaagaatacccactctttccacttcttttcaacatagtactagatgttctagccagagaaattaggcaagaataagaaataaagggcatcttaattggaaaggaaggaatgcaattatctgtttgctaacaacatgatagtgtatatagaaatacctaaacgctccaccaaaacctgttataactgataaactaattcagcaaagttgtaggaaacaaaatcatattgtaaaaatcagtagtgttcctgtacactaacaaactatccaaaaaggaaattaatatataatcccatttatgatagctacaaaaaataatacttaggagtgaatttatttaagatgaaagatctatatgcagaaaactacaagacattgataaagaaattggtaaaaacacaaacagaaagttattccatgttcataattcagaagatgtaatattaaaatgtccatactatccttaaacaatgtacaaattcaatagaatccctgtcaaaattttaataatacttttcacgtaattagaaaaaaaatcttaaaatttacatggaaccacaaaacaccccaaatagccaaagcaatcttgaccaaaaccaacaaagctagagacatcacattacctgacttaaatatacactacaaagctatagtaatcaaaacatcatgtttctggcataaaaacagacatgtcaaccaaagaagcaggatatagagtccagtgaacatccatgaatttataaacaattgattaatcaagatgtatacaacacacaatggggaaagaacagtctcctcaatgaatggtcttggaaaacctggatacccacacgcagaagaaagaatttaagaacttacctcacaccatgtataaaaataaactcaaaataaagacttaaatataaggcctgaaactgtaaaagtgctagaaaaaaagaaggtaaaagctccacgacatagacctgagtaattattttttgagtatcaccccgaaggcacaggcaatgaaagcaaaaatacagatggaatagcattaaactaaaatgcttctcacagtgaagtaaacagttaacaaagtgaagagacaactgtagagtaagagtaatattttcaaagcatatatctgatgaggataatatccaaaatttataaggaacgtaaaaactcaatagttagaaaaataacacagttgtaaaacgggcaaagaacctgaggagacgtttctcaaaaaacatataaatgaccaatagtttcatttaaaaacattcaacatcactaatcatcagggaaataaaaattaaaaacacaagaagatattacctcatagctaatagaatggctatcatcaaaaagacaaaaactaacaagtgttgacaaaactatgaatcctgtacattaatggtgggaatgtaaattagtatagccattatctaaacccgtatggaagttcctcaaagactaaaaatagaaataccattattatctagcaatccccctactgggtaaatatcaaaagattgaaatcaatgtgctaaagaggtatatgctgtcccatgttcactgcagaattattaacaagaactaagatatggagtcaacctatgcatccatcagtggatgaatggaggaagaaaatgtggtatatatacacaatggaatactgttcaatttttttcaaatacaaagttatattcattttcagtaaatagcaaaacaaagtagagtcaggttgggcgtggtggctcacgcctgtaatcccagcactttgggaggccgaggggggtggattacctgaggtcaggaggtcaagaccagcctggccaacacggtgaaaccctgtctgtactaaaaagacaaaaattacctgggcgtggtggtatgcacctgtaatcccaggtacttgggaagctgaggcaggaggatcacttgaaactgggaggcggaggttgcagtgagtcgagatcgtgccactgcactccagcctgggcgacaaaagcaaaactccgtctcaaaaccgaaaaaaaaccaaaaaaccaaaaaccaaaaaaacgaagtggagtcaatgcactaatttttaaatctaacacaatgcttagaacaaactatgctcaataaataaaaacattattattaatggagtacgattattcttgagattctctatggttgtgtgtgtgttttaaacaaaactgagtcgtaggtaaagaaagacatcctacagacacgactgagaagggctcaaagaaaagaacagccaaggagtagtgtccccaaatactaagcaaaatgaatatgggatttttcaaagcagtctagaaatcagagctcactaggtttggagataatccatgttcaaggcctcataatgaaatctttccgtatttccagattcttgatatggaatctgtcacaattttaaggagcttctgccaaaggaaaggagatcgcttatgctgcctgaaatggcctacgcctcctaaatttcctttgactctgtcactaatatagcaagggttcattccagcaaaggattactactgaggaccaactcctctctggtttagattttgctttcataaacacattgacccttgccaaggagagctctatgtatatccaatttcttttctttttatccctgctacacaactctggctacaaaatctaggactctcacagcaatggcagcattggtcagaaggtaagtgccagttcgaacgcaagaactctctaaagttcaatggtcacaatttttttttaaccacttctgccacgacttttttttctctttaccttgccaattatttcttttaaaactcaatcctccaagctacattctgagcactaagttttttgaccaatgcatctctggtatcctcatcatctttttgcagatctatgtcaccttgttgggaccaaatggggtatctatcagctctctgaccagccgctaagaaggaggaagtagcctccaactcaccattattttttaagaaggcctgtgtaactgttggtagatccaagttaaatttttccattaactgccgaatgatcttaatggcaagctcccacccctggtggagaaagtccccctcctcctctgtctctctccctcctcctctatctctctccctcctcctctgtctctccccctcctcttctgtctctccccctcctcctcttccccattctcaccctcctgctgtccttctgtcttcctcaggcatgggtggattatcatcacacattgttatatgtatttcaaaatcagggctcttgatccacttgtaggaattgcctttccaggagtcctggacggttctcgcagttcagttttccatctttctgcgagatgctaacaaaaccatgcctctgatccaatgcctccatttagctgtaacaatacgttaatcagaactgcctggcatcctcctgaacaagactttcaatagggcccagtatgtttcgcttcatcctgaagttttctcaagcatctgctaagatgcttaagtactcttttgcagtgggactaggagccagcagaggaacagatacacgttctctcaagacgtctctccagcagaacttttcccctttgtttccgaggccttggattttcccaacatttccagtgtatatgaacaagacacaatgctatcatacatccccctgcaactttaaaaagcaggagtaagcagtacttccagccaggccaccaagcaccatcatgtacctgcctgacagcccaaagccagcattataggtaactctggcaggactaatccccttcattggtccaccactggtcctgctaatgacaaagacttatattcccctattagcctttactcagatggagccagtttcctatccttgtggtggtcagatggggttttgctgtatcagaaggcagtccagccaaacccgacttccttcatttagctaatagtacagttcctgttgttttcacggtttgccttatttctgaaagactcagcgaagccatagcaatcataggtaacggggatagcattacacatctgtttcttttgccacattatcccaactggttcaaagccctgaggaaagtagtcactttattggccactttttcatttataatcactttagtgttaaaaatatttacccacagaatggacctaagcgacctggtcaagtagaaaaggcatagaactacactgtagataacactggtacactggctacacctttttctacttctcctgtttgcctctcccctcccccacaccaatggtaatttattcttcacacattattcttcatttccagaaactgttacttcatagtaattacttaagcaggagcacgaaaatccctgacaagtcattttcatcttgtgtccagaattggtgggttcttggtctccctgacttcacgaatgaagccacagaccctcacggtgttacagttcttaaagatggtgtgtctggagtttgttccttctgatattcggacgtgtttggagtttcttccttctggtgggttcgtggtctctctggcttcaggagtgaagctgcagaccttagagatgagtatcacagctcacaaaggcactgcagacccaaacagtgggcagcagcataatttactgcaaagagctaaagaacaaagcttgcccagggcagaaggtgacccaaactggttgccggtgctggctctggcagccgcttttattcccttatctgaccccacccacatcctgctgattggtccattttacagagagctgattggtccattttgacagggtgctgactggtgcatttacaatccctgagctagacacaaagtgctgattggtgcatttacaatcctccagctagacataaaagttctccaagtccccaccagattagctagatagaatgctgattggtgcatctgcaaatccctagctagacacagagtgctgactggtgcatatacacttctccctctagacataaaagttctccaagtcctcacccgacccaggagcccagctggcttacccagtggatcccctgcaggggccacaagtggagctgcccgccagttctgcgcagcacgcctgcactcctcagcccttgggcacttgatgggaccggacgctgcagtcgtggagggtcgggcccgcaggagcccaccgtgcaggttgggggggcgggactcaggcatggcgggctgccggtcccgagccctgccccgccagaggcggctgaggcctggcaagaaatcgagcagggcgtgggtgggctggcagtgctgggggaccccacgcaccctccacagctgctggcctgggtcctgcgagcgccaccacagtcccggttcccacccatgcttctccctccacagctccccacaagcagagggatccggctccagcctcggccagcccagacaggggctcccacagtgcagcggcgggttgaagggctcctcaaggtggccagaatggaagcccaggaagcactgagagcgagcacgggtcaccagcacgttgtcacctctcagtctcatactaaatttgttttcactgagtcatgttatgaattatatagtcacccgcttaaacatttcaatgctttaactgtcttgaaaaatataaaataaaaaaattaaaaaaaaaaaatcagggctctcatccaactccctggtggcttccgcaggcatgttttttgatggctgcttcatgcttctgggtttcttccttcacatgttcttcaggcaaagctggaattctcttattccatggttcccggcaatcctcaggctccgggtcctgctctgccttctgcttgagcgtctgggagcgcagcgggggctcctggggcattccctgctcctggccccataggttctgaggggcctttcttccgcgagccggctttcctccatcgcttcccacaggctttgcccgcgaccgaacagggcgagcaggcattttccttcacgtaggcctgaaaagccacgtcacccgcatccctgaaggcggccccaccagcgactacggcttgggctccacggcgcgctctgccagggaccccccccccccaccgccggtgcccgagtgggccgcgtaggcggggcccagcccataggccgccagctccagccgctgcagcgttctacgcggtccgggacgcactgcgcagacaacaaagctgctggaggcgtccccaggctgggccagcggtgtggcctgggttcctgcaccgagtggtgcagcagctgcttggctgggctgggcagcaggtataaggacctagagttgccgtcctccctggtgaacagaatcgaggaatggttgggcccgttggggtctttgcccagatccaccgcctccaccatgtttgacgccgggcaccagaggagccgccccctcccgagcgccatggcacgcacagagcgactgactgagccactactgatttttaaaaagaaaatattcctcttatttgtgacaacatggatgaatctggagaacatcatgctaaacgaataagccaggcacagaaagacaaatactgcatgctcttaattatatgtggaatgcaaaaaagcttaactcagaagcagagtagaatggtgactaccagaggctgggggcaggggaggcaatagggagatgtttgccaaggagtacaaaacttttgttagataagagggatatgttaccatgcaaacggtaatcaaaagaaaataggagtggctatacatatatcagacaaagtaaactttaagtcaaaagttgtccctagagacaaagaaggttattacgtaatgataaaagggtgtattaaacaggaagatagaataattgtaaacgtatatgcaaccaactttacagcacctaaagttaacattgagagagaagaaaggagaaattgacagcagtagaacaataataggaaactttaacactccactttcagtattaaattgaatatccaggcagaaaatcaagaaatagtgaacttgaacaacaccgttagccaaatggacttaacagacatgtacagaacttttcacccaacagcagaagaatacacattctttttaagcttacaaggaacattctccaaaatacatcacatgtgaagccacaagacaagttttaacaaatttaaggagatcaaaattgtatgaagtatcttttctgaccacaatgaagtggaactagaaatcaataacgaagaaaggtggacaattcacaaatacatggaaactaacataatcttaaaaactactggatcaaaaagagaattttaaatacatcttgaactgaataaaactgaaaaaacatactaaaagttatgggatgcaataaaagcagtagtatgaagaaagtttgtagtgataaatgcctaaatttaagaagtggaaagatatcaaataaacaacctaactgtacacatcaaggaactagaaaaagaagaagcagctaagccaaagctggcaaaaggaagaaaataatagggattagaatagaaaaaagtcaaacggaaagtagaaaaactatagaaaaataccaaaaataaaaattgccttttagagaagaataaaattggcaaactcttagctatactaagaaaaaaagtaaagaaacaaaagcagaattaaagaggagacattacaacagatccctcgaaataaaaaggatcataagagactattatgaacaattatatgccaacaaattggataacatagaggaaatgggtaaattcctagaaacatacaacctactaaggctgaaccaagaataaatggaaagccggaacataccaattacaaagatattaaagtagtaataaaatgcctcccagcaaagaaaaatccaagaccaattggcttcacaactgaattctaccaaacattcaaagaagaaataacaccaatccttcttaaacttttccaaaaaataaaaatagaggaaacacttctaaccgctttatgagtccagcagtactctaataccaaaaccaaacacaccacaagtaaaaaaaactacagaccaatatctctgattaacatacatgcaaaacatctttgataaattgctagcaaaccaaattcaacaacacatcaaaaagtttatacaccatgaccaagtgagatttatcattgggatacaaggttggtttagtacatgcaaaacaatcaatatgataaaccacattaagagaatgaaagattaaaaccacataatcatctctatagatgcaataagcacatttgatgaagtttaatatcctttcatggttaaaaaatccaaggaaaatagatatagaagatgctgtggtatgaatgtttgtgtctctaaagttcatatgttgaaacctaaaccccaaagcaatagtattaagaggtgtgggctttaggagatgattaagtcaggagggtttctccctcaaaaatgggattagtgcctttataaaagaggcctaaaagagttgttcatccttctaccatgtaaaaataagaagatgccatcttgaaacagagaacaagctctcaccagacactgaatcagctaatgccttgatcttggacttatcggcctccagaactgtgagcaataaatttttcgtgtttataatttcttattttaagagattttgctattgcagcccaaacagataaagatggcaggaaatttcctcaacataataaaggccatttatgacaagtccacaaagaatatcattatcaatgagggaaactgaagcttctgctaaggtctggtaaaagaaaaggatgttccttcttgccacttctatttaacacagtactgaaagtactagcaagagtaatcagacaagaaaaagaaagagaagccatacgaatcagaaaggaagaagtaaaagtgtctctgtttgcatataatatgatcctttacttagaaaactgtaaatattccaccaaaaaaacttattagcaataataaataaattcagtaaagttacaagacgtgaaatcaacataaaaatcagctggttctatacactaacaaagaaatatctacaaaggaagtcaagaaaacaataccatttacaaaagctacaaaacgataggaataaatctaacaagggaaataaaagatctgaaccacctttccaaagaaaaatttttttttagagatggggtcttgctatgtttcccagactggtctcaaactcctgtcctctagtggcctcccaaattgttgggattacaggtgtgaatcaccatgcctggttcaggtaaaagatctgtatactgaaaactataaaacattgatgaaagaaattaaagagaacattaataaacagaaagaagaccccatctctacaaaaacaaaaaaaatcctaaaatattagtcaggcattgcggcacatgcctgtagttccagctaatggggaggctgaggagggaggatcacttgagcccaggaatttgagggttccgtgagctatgatcacaccactgcactccagcgtgggtgacagagtgagaccttctctcaataaataagtaaataaataaataaatagaaagatatcctgtgttttggtttggaagaattaatactgctaaaatttctatatatcctaaatgatcgataggtttaacactacatagaaattttaatggcattttccacagaaacaaaaaatactaaaatttgtataaacccacaaaaagttttaaatatcaaaataatattgagacagaaaaataaggttggagcatcatacttcctgacttcaaaatgtattgcaaagctacagaaatcaaacagaatgctcctggcataaaagccaacacatagaccaatggaacaaaataagaaactcataaataaacccaagcacatatggccaattaattgtcaacaagttcaccaggaagacaaaatgggaaattgatagtctcttcaataactgatgtgggtaaaaccggacatctgcccgcaaaagaaatctgacccctatcttacaccacacacaaaaacaaactcaaaatggactaaaagcttaaaaaataatacctcaaaacatttaaattctaaaaaaaatacaggaaaacttcttgacattagtctgaaaaggattttttaaaaaataattcaccaaaagcacaagcaataaaagccaaaataagtaaggggcattacatcaaactaaaaagcttctgcgtgccaaaggaaacaatcaacaaaatgaataggcagccaatcaattgggagaaaatatttgcaagctatatatcttataagactttagtactcaagatacataaggaactaacactcaactcaatagcaatgaaacaaataatccagtttttaaaacgggcaaaggtcctgaatagacacatctaaaaagaagacatacaaatgactaacaggaatataaaaatgtccaacatcattaatcatcagggaaatgacaatcgaaaccatgagataccatctcacaactgttaggatagccattatcaaagagacaagatataacaggtgttggtgagggtgtatagtaaagaaaacccattgacactgttggaaatgtagattgttgcagtcatattggaaaacaatgtggagtttcctctagaaattttaaaaaatagaactaatatatgacccagtaatccctcttctggctatatactcaaaggaagtgaaatcaccaccttgtaaacatatatgtgcttccatgttcattgaagcatggtttacaatagccaagatatggaaacaaacaaattgtggtggggagtgtcatcaagatggcaaaactggagatactagcctttatccacccccaaagaaaataaatagctatccacaaatgaaaatatctctaagagggctcaaaggcacattaaagaatgtgaggcaacacagtggagcaaaaacaataacaacaacaaaatacaataaaaaaggaggctatccacagaaaagaacactggtgagactggcatatctgagactccaggagatggctagggtcaaagaagaaaggtgaaagctactgatatcagccgcatggcaggaaccaccatggtccccaggggccttcttcaaacaagacactggcatgttttgtcactgagttaagaaacagatatttctgttgggggaaccccatagaggaaggcacagcttcacaaccctcccttacccaagaagctgctgctgttgagccactttgggaaatcacctgcctcctctctcaacctcatgcatgccataacccccaagcctcagctgctccatggatgcccacgcttcagagactggagccatcaccataccaagctggtgtacactccaggccctggagccaaggtctctctaagtgttccctgaatccaggcacaagctgagccgtcatagagaggcaggccctgacctgatcctgaaacactgtaactctgaacacacctgtggcaggaactggggagatgtatattaaaggatacgaagtctcagtgatacagacgcatgcatccagagatctgaagtacaacatgagggctatagtcaatgatattgtagtgtatactgcaaattttctaagaggatagattttaggggctcttaaccacatgcacacaaaatgatagatgttaatttgcttgactgtagtaatcatttctctatgaacatgtatcaaaacattatcttgtgtaccttaaatacacataataaaaaagataaggcgaatgtgaaaactcagcggagaccttctatgagtgcccctccaccttccttgtgtttcctcctgactctctcttgcatggaacttctattgcatgcagagaattcattttgctgttttcaaatatatgctattgtgctattctttaagactactacccataataacactgagctttaaaaatcattccctacttatagctttttagcctataagcttagcttactagtgtaagaaagaaagagaaaagaaacaccaaaagtggcttaacaattaaagacaggtttattttggagaataaacttgagaggggcttctggccaagttaggttagaggcattttttcttacacactaagagtttttaagggtttgatgtgggacagcttattataggcttggaatgtttcttgtgtttctttgtctcgcttatctgggagggagagtttgtgtgcatttccatccattttcctgaagctgcaggtataccccgagtctacttttagcttccctatcttagtgcacgtaaagggaaaggaatgtgcttactagggcccactgtttcactggggcccattgtatgagggtgaagtttggctgttacccaagagactttcccccctccctctgtgcccaaggtgtcttatctgtgttttactgtctgctccttccggctgcttgtagttagaagagaagtgacttccttgaaatgcaggaggctagaaaaggggctggaaattaaagtggcgatgtttgactgacatgacggtgctcctgccctgtcattctagaccctatagttataaaaggatgaggggcaatatttttgtttgtttgtttgttttgctacttcctgctggggggggggtggcagacagatttctggttttggattggctgaaggagcaatgccatttgtagatgttttgggtagttgtttgtgaaatagccatgattctattggttaagaatttttgaaaaagctgaattaggtagggtaaaaacatgagtcctgggctttttagcagcattttttattaggcctgattggttgagatagaagcaacttttttttttttccaatgagaggtagaggcacatgtttggaaaggcctatgtgttattttttgttagtaactgttattcctactatgaggatcataattaagcaaaatgctacagtaattgagattctctgtccgatattttaccctgagggtgctaccgtatatagttttcctgcaaatagtaaagtgagtaaagcaattcctgcaagggtggcatagtaaataatttccattaaaaacgttttaatatttggcttaaaacgagaagtagaaatgacaaaaagtatttggtgagatagaggtgagactgagtaagatgagtaatttttacttacgaacttattttttgtgcttttagcttaagattatttatgttttgtacattgatatttgggacatttctctgggctgttaggagttgcttcctcagatttttaagctttgacttgagtgtgatgtatttaggagttgatttctgtaatggatataagttaaactgtagcaaatagtaaaaactgaaaaatattaggcaagactagaatttaacaacaggtgtgctatagtgtttgaaacataattttctctgttccgttttccatgtttattaaaagacaagtcatggtaggactgatttgctttattatacttggcttaattatttgcatacaattcagcaagaataactatttgctacataggccttttaaattggctttgatggcactttgtttcatagaaggaatttgagataagactttttgaagccaagcccagccatggatttgtactattaaacacctatgagttggcagaattcctttcctcttcaggttttaagataacttggggttcctggcctgcgagaaactgacattctttacttaccacaggtcagaaaccctgtacaggggctgtgtacacagaatctgaggccagtgtccaagggctatattggctccataagtcaagtttgattccttaaaggagagcacaccattccagtcaaagccttggcaaaataaccagtttctccaattgtgttctgttacaaaagaaaacaggttctttttttttttttttttttttttttgagacacagttttgctcttgttgcccaggctggagtgcaatggcgcaatctcggctcactgcaatctccgcctcccaggttcaagcaattctcctgcctcagcctccccagtagctgggattacaggcatgtgccaccatgcccagcaaagtttgtattttgtatttttactagagacagggtttctccatgttggtcaggctggtctcaaactcccgacctcaggtgatccacccgcctcagcctcccaaagtgctgggactacaggcgtgagccacctcacccggccagaaaacagatttttttttttttcagatggagtcttgctctgccacccaggctggagtgcagtgttgcgatctcagcttactgcaagcttcgcctcccaggttcacaccattctcctgcctcagcctcctgagtagctgggactacaggcgcctgacaccacacctagctaattttttgtatttttagtagagatggggtttcaccgtgttagccaggacggtctcgatctcctgacctcgtgatccgcccgccttggcctcccaaagtcctgggattagaggcgtgagccaccgtgaccggcccagaaaacagtttcttatcgcacttatgcaaacaactatattggtgtaatttaagaatacttataactagtttttaaattctagaggacctaggcagagagaaacacgctttaaatcctatttacaggaatatactttacttagctgtgaaagtctgtcactagcttaagacaagttttcttgactctgaaaaaataaaataaggattagcagtgttttaagcaaaaggtaaaaacttgttttggttttctattagtttagtccattttcttaaattttgcttgatatttataaacattttagctttccatgaattttgtacattttttgttgttgttgtgagaaactcatgtttgagagcacttgttaaagtcccgcagcttgattataaaccatcttttgaaaagaattaaaacgaaacaacaattgtgtgcaaatgacaaaatgtccagtttggatacagttagaaacacaattaacaaagaaatttagtcatttttgtggtttacaataacccaacataacaaccttaattgtgattgatagcacatattcagacactaacattagacatttcatacagttttggaacatatgttaatattattccctaaaatataacttattaggcagtgttttggcaattttatgtacctaaacatgttaaataatcctgtttacctttgttccagatgctttaggggccctttgcaggacctaaaatttaggggttaggaaagacaattttgagactaaagtttggttttggaagcctgttaaatatgtttaaaatttaaaccatttgatattatgaaatggaattttagattattatttttgttcatttgtgtgtttgttttgtttcgttttgccaaaatgatgagttaaaaatttggaaaagcaaaaaccatttattagccttttttattacatgaaaattctgtttaagagagaaagttacattttaccctttcattagtttattaatgttaaccctaattttaatgaaaccttatagacaattctatttaatcttaaccagtttgactatgaagtgagatttttacatacctgttataatccttgacacattttgctaaagagtagattagcattttaagaaaaccttgtggtgcttttattttagtgtttaatttacagaaaaaaaagttatacccttttgagtttagttaatatacttacacacagagttttctttgcagaattaatttttataatgtttttacaatttgcttaatccattaatttaattttaagataacttatttttaagcaaaatgtacatttttgtaccttcttttaatttttgactgaaacactttttactgtttttatgcaccttgcatgtaaattcatgtttagtagttttcactacatgtcataatggtaacttttagcaatttttaactttaatgtaaaacctgttaagttttttaaattatgtgccagatgcagatgaagtctgactttttccagcatagttaggggcatggttactttgatatgtttctggccttatcaattgtgaagcaggtaagttgacagtttttaaaggataaagaagcagtttacaaccttaaaacagcaaacctagtatctgacctgcctaacatatgccgcatttttacaccttgaagacattggtattttaccaataattcctaagactgtttttatttttaaatattaaagttacgtgaactgaaaggtatcacaacttttacttttcccttaaaaatatttgatttaagcacttatttttcttaggcaattaattagccctctttttaatagacatggcacacataacacgtgcatagccacacagacaaccagaagaagaaccagtcgttgtaagatttttcattttttgctaatttccctgttggattattggccttcaggtgaggccctttaagaacagtgctaggaataccgtttccagggcctaataaacaagcagagccagaagacaaagacagactttgagaggtacttattcacctctacttccaggggttccatgaggaaaacagagatttttcccaaaatgggatttgtggtgccttttctgttttcccaaggagtcccaggccaccagaagttattttggggtcttttacatatgcaccaagagtggtaagacagagtggagagaagtaatttaggtgaccgagaaaaacaccttttctaggaaaacaagatttatgaagagaaaaacataaaggccttttgagtatacttatagcttggatatttaattttaattaagctgagcgttctttctactaggggtgagggtggaggttagaattatagaaatgttatgccaagttaaattacgtgcaggaattccctgtgataatgagagggattttttgggaaacatcccagacactgttcgatttgcaacaaatcagacccggagaaggggacgtgaacatgagtgattccttcaagcccagccactgctgggagagggaggatggcggaggaggtttcactggttggagcaggttttgaaccggtggagaaggaggagggcggggcttaagggagaagaaagcctgaatatagggaaccttttgccagttaccgtctctggtgataaaggcgtcaaggttcctgagaacctgaagggtaaaggtgctgctttgggccgctggctgtcattatctagtttgtactggggccaggacgtttgcaagataacattaaacgctttggctttagactcccgactaagccaagtttgacgaggctgtgaagacgacagttcagtggggaggacgcaggaatgtgggggtgctgggcacccgcgagggctggtaagaggaagccaggggtgtctgtctggttctgggccttcccagacaaaagccagagacccggagcctctttctgagaaggaaccgggcgtccccaagatttcctctagccgagtcccctgggtcccccgaggaccgggacagctctggtacccggagaaagccaggagaaggcagattttacacctcagctgaattagtgtccagcattgggtgttgcagttggaatcggcaaagggcctcagactggagctgcgggaggaagagagggagacgaagagggagagaagaggagggaagagagcaatggtcggagagcaaaataccagttgtgagcggttggagggggagtccaagacctgagggttttgagagcccacaggggaggagccccggccagagtctcacagttcccttcaatgcgaattgctcggaaagtgaagggagaggctgggagagccgggcccggcggcgggcaggcctaaggcggcgcgggacacccactagtcgcaccttttcccggctctcgcctctgcagagggagcaactatggctgcggaagtcctggaggcagcctccgcggaggagcagaaggaaaaggaagataaagtgactagtccagagaaagctgaagaagcaaaattaaaagcaaggtatcctcatctgggacaaaagcctggaggttcagatttcttaaggaaacgattgcagaaagggcaaaaatattttgattctgggcattacaacagggctaaagcaaaaacgaagagcaagcaacttcctactgcagctccagataagacggaggtcactggtgaccacattcctactccacaggaccttcctcaacggaaaccatcccttgttgctaacaagctggctggctgattaaaagagctgaactgcatgaagctgctaattcccattatttctctttaatatgttacttacctttttatttcctttcattcactaagtcatttgagaccgacagctttgcaggtatcagtaatgtgtgctgctattgtggaatatacaggtgtagagtttttgattagtttaacagtgcactggggaagaggacatgtcagagcaacacaagtaaactacttgaaaataactgtatgtattacctaactcctagtgtagtactggttctaacaagtaacaagcaagttttaaaattttaatgttttgactttcattacttcatcttaattacagctttgtatgttactcttatttaatataatctctattgtattgatttcttctgtataaaccttttggattttgtaaaacagaggtttaagaccacaagttagaagaaaggtcacctatttcaaacaactagatggggctccacaagatttgtatctctgtgcttgaacttgaatggccttaaacctgtttcagctttaacagtagaattttacttgggcaatatttgcccattctggtgtaacttatgtgaccctagtgcttaacagctgccgtcgaagctaatattcttattcagttctgtagagtcagaataccttttgttgttgaagatgtgcaatgactgttgaattcacttttgtgccatttttgtaaatacaataattttgcacaacctctcacaaatgcctatatttatttcacatacttaaaaagtagataatgtgccaagcagaagcacaagaggtcctacacaaaactctgtaagtcattatagcttttgtataataagagtagtttacaatctcgggcttatagaataccaaactgaaatcttagttcaatctgtcatagacttaagcttttcatttgttactaatatccatggcattcagtggccttgtgcaaatacgatatgttgcttaggaatatcttttgtcctatgcagaacctttcattttgatttttatgaaagttgcaattcatataatttatataaactttttaaatgtagaaactttttacttccacactcaactttggagacactagagtaaaaggcttcaatactctgcattctatgccccctgccacctgctttttcccttttgttcttcgactcaaatggtattgggttgtttgttctatacgaaagcataggtgtctatatccttactcttttaaataacacaataatgatgttttccttctaatttctcagttgttaatctctctctctctctctttttttcttgagatagggtctttctctgtcacctaagctctagggcagtagtgcaatcatagctcactgcaaccttactcctaggctcaagctaactattcttaatcctttattattaccaatattctacaattgtttaaataaaaggaactttataatcaaacagtacagaatactggctcaagaacctatgtcaagatgagctgaattttggtacattattttaggaattatgacaagctaatagaattgggcttgtgacaatgagagtaattcacatgacaggtaaaacttactcatattaaaaatgtttagatatttgcttctatagatgtcactttaataaaataacaatttagttttacttgtggcttacctagttagcaagaactttaacagactttattgggacaagcttactgctcttgtaggagctcctctcacaagtagttgtaatgctgtaccatgatactcaggatcagtaacttcagatgttactatctttctcttcatctttgacttgcagagagcctcctctttttggatccaggcatcttttctgaatcctggttccattagtatacctgctctcctatgatcccaaatcatagtcaatggtgcctccaacatagcaccttcagttaaaggctgcctagtgctctgaggaaagcttactgattatcttcctgctctactcaccccgaaaggcagaaaagcaacatagtcactcctgtgctcatttgtaattgtaaagatcagagatatagatatttgtaatgagagcaagtatatactcattataggatcaatttaagaagtttaaaatatcccaaagtagaatttctatatctagtcttctgggtttttttcacgaatatttgcaagtgattacgcttaacttcacacatgaaagattaatctgaaaggtcagagagaccctgttattcctgaccacgatagaactgctcctgtggtttgggacaagtaacaaaacaactgcttgagttttgtttgtaaaatacactattaatatttgacctacctcaaaacgtattgaggatctgtgaaacactaagtgcccaaaataaaatattgctgattgtctttttattaaaagtaaatttcctcattaagccaaccggccttctgtaagtcacagtgctcaagtctcagggtttgtcattaggagaggtctgtcgttaaggatttgtaggtgtaattgcctagcctccattattggtgattgcgatagagaggttttacatttttctgtttttcatcctgccccaaagctcagtttattgaagacatttgtaagctattggatcatcacttgaatcaagattttgactagtgagcccaattgtccctttcttattatttcaaagctatagtctgagaaatggctaattttaataactgtcctatcataaattaatgttggaataaactgaagttggagatgaagacttcatgaaaactaactaaagtctgaaataaatcacctgttttatgtccaatagctactgcctttgatagaacagttttgaggaacatttcattcttgaaggcagcatccgacatggttctcagcaaattggaatagtaaggattgttgggttgtttcgatgagtggaagcagcgtttgtagcataaaagttattcaataatcttgtgctgttgacctgaaaatgtgtcttaactattcatcaaggcaagcctggtgaagcctttacttgttactacttcaacagttggaattagttgctctttttacttgatgaagcaaaactatacctctgaatatttatggatgctttttacaaaatcaggcttgtgttcttaatccgaattagtaaagttttatggaagctgaaatgtaatacagtagtctccccttatctgcaagagatacagtccgagacccctagtagatgcctgaaacctcagatagtactaaaccctgtatagtctatgttttttcaatctgacaaccaaggcggctactaagcgactaaggggcaggttgtatacaacctgtgtggataagcaggacaaagggatgattcacatcccaggcaggacagaggaggaggatcatgagatttcatcactacatggcttgtgatttattttattattattttttttttttgagagggagtctcgctctatcacccagcctggagtagtggtgcgaccttggctcactgcagcctctgcctcctgggttcaagcagttcttctgcctcagcctcccaggtagctgggaatgcaggcgcccgccaacatgcccagctaatttttgtatttttagtagagacagggtctcaccatgttggccaggctggtctcgagctcatgaccttaggtgatccgccctcctcggcctcccaaggtgctgagattacaggaatgagccacagtgcacaaccagcttgtgatttaaaacatggtttatttctggaattttccacataatatgtttggaccaaggttgcctcgggtaacaaactatggaaagtgaaattgcagataaagggagttactgctgctgtgctctaaaattggtgtttgggtgatcaggagtgggtagccaatgggaagaggtgatcaggagcaggtagccaatgggaagaggtgatcaggagcgggtagccaatgggaagaggtgatcaggagcgggtagccaatgggaagagcacttctgagtgatcaccaaagcagtttctttagtggtcttttcacattctccaatgttcaagcatattttccactttccattttctatttcacctcattttgcctcatcatctgccatccctgcttatttcttaagcctactgatggcactcactaaattgtgtttagggctaatgaatcattgttccttaatatccttttcaatatgccacaatttagaatgcatttaaaattttctaaaacaatatcctactctgaatattaactaatttgagccacattcccatctctaactcagcacaaagtgccagtcttccccaatatctcctctcaactccccaccgcaccttataaaattggaatcagaaatctcactctgtcattgctcatcttagaataaaaacactgattttaatactgttttactagtttcagccttctaagtacgtaggcctctaggtattctgcagatcactggtggtcttgatagccattcatatatgttcgtattatgttatttttcaactaaatcgcaattggaaaaaaacatctttaatattatgcccttggatctgttacttcattactaatacttgtgatgcaataggacacttcacctgtactaaaagggccaagagtaaatgtcttgttttgttgttgttgttaaacatgtctacagagttggcagttaatgctgaatttgtcaaatagctcttccaaaattatacttgtatttaaaaaataaatggatctacctaatttctattcatctaatttgcagttttgtcttattaaagtggtatgtttttcaatgtatttttttctgaagttgatctctttacatttcagctattactgtaggcagaaagaaattgacttgtaatctttgatttttttgcatttgtaatggctttgtacttaaggtaggattacatgtttacagattgtgggggaaaaaaaaagaaaagtgaagggagagaaaagacaaggcgagtggccagagaccctcaggatccaagagttaactctgattaactcagatgctttgttcagccaatttcagacttcttttttcctaatacaagcacttaaggataagcctttctgtaagaactgccttacatgcatcatagtattttaaatgtagtgttttcattcttcttctagtctaattaccttcaacttctattattagttctcttagacccattagttatttaaaattgtgttattaacaatttctaagttcatggggtttcctctttttaaattgctctttaccttcgttgtccttcgtggtgctctccgtggaaacctgctttctgatctagtaagtgcttattctttgtgcatgtccctagacttgaaatcactgcataatccctaactgtgtgtgtcctggcttagtgcatctaatgaatgactgaatgaatgcatctttgcctttgccttacccccgggcctgaaacatcgtcttggtccccttctcaataccttggatccttggagatcaaggtcctggttgttctggcaagttcaacacaatctggcctcatgatcagagtcctgtccctgaactcaagacaagggagggatgggcagaattacctcatgctgtgccaggaaatatgagtctcatggggcatggcctgtgtgcctgggcaaattcactgcctcactaccctgtgctgagatgatctctttttttttttttttttttttttttttctgagatagagcctcactctgtcaccagactggagtgtagtagtgcaatctgggctcactgcaacctccctcttcccggttcaagcaattctcctgcctcagccgcccaagtaggtgggactacaggtgcgcaccaccatgcctggctgatttttgtattttcagtagagacggggtttcatcatgttggccaggatgatctcgatctcttgacctcgtgattcacctgccttggcttcccaaagtgctgggattacaggcatgagccactgcgcccgtccaatctctctttcagggacagatgttcactctctcttgcagctctgcctgccagactaagcctgaaaatatctctgcatctggcattcctttaccacctatgtggggcacaacccagaacaaagtccctccaagtgtaccctactctctttccattatcatttctctggtctgagatagatgtttatgacctgccaataaatgcagtgactcaaactccagtgcccatactcctcattcatacagccatgtttagggaggctctagggagaaatgcacagtttgacatcgttcatgaagagcctctccacggctcctgcgcctgagacagctggcctgacctccaaatcatccatccacccctgctgtcatctgttttcatagtgtgagatcaacccacaggaatatccatggcttttgtgctcattttggttctcagtttctacgagctggtgtcaggtaagcctttcagtttggactgttgtttttctccttgttgaataatattttgagttcattcatgacaatgatctcagcacagtgagatgcaggaatctttggtgcttgcattctccagcttctcctggcctcaggctggaaactaccaatgccaggagctgtgggaagcacagggcagcaggaattgaggaagactccttgggctgtttctcaaggacttgggcactatcacagtagctcagaataatgggagcaggccctgggagcagggagggaacacattgagaacgccaaggtaaacacattgttctccccaggtgggctgtggggcttaggcaggggaagtctctaataaaatccccaggtttttgacttgggtgcctgggtggaaggtggcactgtttaggatgtttggagaaaaagacaatgtgtccagttatgcacatgctgagttagaaacacctgtagttatggggtagagcaccagacctttaagtgaggagtaagttggaacctggcatagtctaggcagaaacccactcttctttctccttctagtaaccatcaagacaaagcctggtgtataggatattcagtaatcaaataaattttgcagggagagataggggctggagtagaacactggattctgggtggtcagtgttaagccacaaaaagttcatttgactgtgttcactttctgtctggaacagttccatcctgctatttgtctacctatgactgttttgctaaacaaagccaacaaaacagaaataaggggatcaaaatccatgtgtgctcagagggcgtggtggctcacacctgtaatcccagcactttgggaggctgaggtgggtggatcacctgaggtcaggagtttgagactagcctggccaacatggtgaaaccccatctctactaaaaacacaaaaattagccgggcatggtggtgagcgcctgtagtcccagctactcgggaggctgaggcacgagaatcacttaaacccaggaggcggaggttgcagtgtgccaagatcgtgccactgcactccaacctgggtgacagagtgagactttgtctcaaaaaaacaaaaacaaaaaatcacaatccacgtatgttactcacaagacagcctccgtttaagtacattctcacccattttctgacaagcctttctgtctgctttctgtttctgcatgaggcagcagggcatgctggaaatgaccttagaggaagtaacactatttttaaaactttccttttctctatgagcttgtggctaataacttctattagcatcaatttttgcttatgatgacatagagataataagatcacatctgtgacattcctgtggctgaagggctgctgtgtggattgcgtgaactcgtgcatgtagagcgtccagcacggagctccgctggggcacagtatgttgcgacaacagacagtgtcattccttgcttctccccaggggaaggagtaaagggagacgctgtcggcaagacaaatgacagcagcaaggctggccggagaaacagacatatactaaaaactgtttgcctggcttgagagtctcacacagccttgaaggcagcactcacagcagcccagctgacaggctgggtcccaaaagctgatctagagcaagggcctttctgcaggtggtttgtttagcagactgttctcagaaacaaaagtgacagggtgcagagagtgaagccagcgggaggtaagccatagagggtgcgctaatgagcaggttgctgcggtggcaactgggacccagtcccactgggtcctttggaggaactgtatagacgatggctcaggatcttcccaacatccactgcttcctgttccccactgggtgagatgtgcccctccgggactattaaaatcgcaaaccttcttggccaccctgtgcctgggctgaggaggttccaaaggttgcaagaagccatcagcagagaggcagaggccaggctccaggggcggagctgtcagcaggcaggcaagtgcccatcccattccagggggactcagggttgggtggtgaggagcagggcctcaacatctgctacaccaggtcagcagctggtctgacaccaggctgcaaagtcacgcctcacttaataatgctcttaaagatgcatgagtgaaatacatttcagcaagatttataaaatgtacttaaacttagaaataattagtgctaaaattaaaaatatccacttatctggaaattcacacatgggatccactttgcctctgatgcacatgcagataccacacacagatatatccatataccataaatggatacatgtgaatgaatcaagagacactgccaatcaaagggggtgggtacttagaaggtgaagggagtgggcctccatcgtttgtggtctctctaagaagaactctaatcatacagagttgtaagtgtgatttgcaccagaaaaattacttagttgaccacaaaaccaagaagcaaatgcaaaaagaaagtagcgctcaccattcctaggcataatccctgtctgtggagcccattctccatgctgggcatggggaatcctgtgctgagggaaacacacacactctgtcctcatgaagctaaaagtcgtgcagggaaggctcgcagaaaacaaacagttatgtcacttgcagcaagatgaagacagtttcaagtgaagatcaagacaaagctgtaccaagaaaatacaaacaaaacaaaacaggtaagccatgttgataaagcactagagtgggggtgtccaatcttttgccttccctgggccatattgaaagaagaactaacactaacgataactaatgaatgaaaaaaaatcacaaaaaatcttataatgttttaagaaagtttaagaatttgtgttggaccgtattcaaagccgtcctgagtctcatgcagcccacaggctgtggcttggacaaacttttgctagacgaagtactattcaagcacgaaataataaagtggaaaaacataaaattattacctggagtaaaatgtaggtgtcatggaaaagatatgtcacaacatcagtgcactaaagggcaaatctctgaaataaaaactacaaaatctcctcactgtgtcacaccatgtccttcagaatatggcagaagtctacttaaaaaaaagaagcacaaataaatgtgcttcagcggagaatatatattcctttcttgtatccataaaacatttacaagatgtaatcatctatttgaaggaaataaattttcccaaattcgatattttatggccacttactcccctcctgggtcattaaaaaaggtttttagcatagaagatgcaaagggggtggtgtgagtgttcattaagcagatgggcagagaggagagcacgtggagatagattctcctccagtcagggagtctgcatttggaaggtgcctctcaggcccctgaataactcatccccagagacagggtttcctcatgttgaatgtgggaatattgatagcacatacctcacctcatctcacatgagatgtgtgtgagaaccgagtgaagtaactgacatggaagcattctcgcaagtgtaagatgtgcaaatgcaagtcatcaggtttagaaagaagactgatggatcccccaccccataccccacacttctccacccaccagagccctgagaaggactcaagtggattttgctcagttgtctgttatgtttcctcctataggacagtggcaagtcactggaccgggcaagtttgtccaggccttggtgggggaggacgccgtgttctcctgctccctctttcctgagaccagtgcagaggctatggaagtgcggttcttcaggaatcagttccatgctgtggtccacctctacagagatggggaagactgggaatctaagcagatgccacagtatcgagggagaactgagtttgtgaaggactccattgcaggggggcgtgtctctctaaggctaaaaaacatcactccctcggacatcggcctgtatgggtgctggttcagttcccagatttacgatgaggaggccacctgggagctgcgggtggcaggtcagttgtttatttatgactgagttgtcttgtaaagtcatgctaccattatcagctcttaaaagtatttcagataatgaaataaaacagactttccagattctgacatgatgtaaaaaggcttcggtggggatcactgacctgaggtttctggagatgagcctggccctgccatcacacaggtgggatcatgatgcagaagacagccacctgcacctgccaccacctgacaggatacagaggaaagccactcccaatgttggtgaaatgagagtgataatgcctgtcatatttcaatttcttttattttcttcttttttcttgacttcttgtgtgttactaaactttttttaggattccatcacaacttattgttagtctttttttagtataacattttgtagtgttttcttaggtgctgctttaggtgttatgatattcatatataatttatcacaatctactatatcaacattttaccactttgaagtgtggaaacttcattttcattcagagcccttcaaactccacaatttaaaaataacattgccttgagtatttcttctatatacataagcactatatcagatagtgacttaatttctgtttaaaccatcatatataattttcatttttattttttattttttatttttctttgagacagtcttgtcccgtcacccaggctggagtgcagtggtgtgatctcagctcactgcaacctccacctcctggattcaagtgactcttgtacctcagcctcctgagtagctcagattacaggcatgcgccaccacacccagctaatttttttttgtatttttagtagagatggggttctgccatgttggccagctggtctcaaactcctggcctcaaatgatcccctgccttgggctcccaaaatgctgggattacaggtgtgagccaccacacccagcacatatgtgattgttaaacactaataaaatggaaaatctattgtagttttccttattcttctttttctattgcttttcttctttcctaatattccaagattctttcttttatcatttcctttctgtttgaagaatttcctccagccatccttttaggataggtctgctagtgacaaattctcttagtttttgtttatctgagaataaatatgcaaaagatttcctctttatttgtgaataatggttttgccagatatagaatttctgagtttcttgatggttattttctttcagcagttgaaaaatgtgctacttctttctggccttgaagatttctcacgaaaaatctgctgtcattggtgttttctttattttcagaaatttaattatgatctatcaaggcatgggtttctttacatttctcctatttggtgtgctctcagcttcttgaatctgtagtttcatgactttcacctcatttgattagatcagccatcatttctttaaatactctttcagctctctctctttctcctctccttctgggactatgatgatataaatgttgatattttgttattgtctcataggtccttgaggatctgtttttccctttaaaaaaatattttcctctcttttcatgctggttaagtttcattgttgtatcctggagttcaataattttttttttttttttatgagatggagtctcgctctgtcgcccaggctggatagagtgcagtggtgcaatctcgctcactgcaagctctgccttccgggttcacgccattctcctgcctcagcctccggagtagctggaactacaggcacctgccaccacgcccggctaattttttttgtatttttagtagagacggggtttcaccgtgttaaccaggatggtcttgatctcctgatctcatgatccacccgccttggcctcccaaagtgctgggattacaggcctgagccaccatgccaggccaataattttattttctgtcatctccactctagcattgaagctacccagttagtttttgtttttgcatttttttctgttatattacttctgatttgttttttataacatctatggtttttgttttttaaattttttgagagaattcataattgctttttgaaacattttaataatagctattcatgttggtcttggcaatcacatgattgtctattttcattcaagttgatatttaattggttcttggtatgatgggtaatttttagttgaaatctaaatggtttaactattgtaagatactctagaccctatgtaaagcttctgttttgcaggcagtcaccatgtttagatttatgactcaggtcctagtctatttttggtggttgtggctccaaatacaatttaattttcagagactttactgtgttattttggtctactttgcttaactgatgtcactggagattctgctcatcctttctagtactaactgtggcagtaaaaggtgttttcccatgttgctcctcactgtttcttgtgagagaggtgatcatctggcatagtgggaaaaagtactcttcccctggtctccagtcaatggggcttatgatcaattcttttgccagcaccactttgtatatcatgtattttcagccatttaggggtggaaagattcccgctgggccacctacttctgctggaggtgggagtgggggagtggtcataggatgctcagctgctgtgttttttttctactcctggggtccctagtcagtcctccttagtctttccacttttcaaaatgcacctatgcttgccgcatttctagggtttatgattttacttagagaaaggagcaaggaagagaagtctacatcatcttacttgagcccccttccttggtgcttacaccaccatcattctttcattaatttattgactaacaaacatttattaggctccatgcactgatccagaccctagggaatgacagagtacaacactcagagaggaagttctgtttggagtggttaaaaggcaatattaaatcataaaattgaagtcaaccacataagaggtacttttgcatatttcccaagtcacaaatctgaatgtcacaataaacccttccttgatgttcagtcctattgattcaacctctcaaatagattctgcacctgccgttccccttctcagagccctcctcctccccagcccttcttttctctcactggagtcacttcagtagttgcatggcgggtcactctcctccggagtgttctctatggtccctcctccatgctgctgcctggagacctctctaacatacaggccttgccataactcccacctgctggaagctggtaagagccttactggtctacagttcttaaagtggctgtgggcaagtccacgttgctcaggtcagtgaaggtatgacctccacggcttgccttgtgcctttttcagatcttgtctcacacccctactctcttatacatcatctggaatataaatattcatgagtccttgaaatcactgtggcatgttaacttttcacattgtggtttgtacttgcctctttttgtctaaaatgcttcccctctcccagacctgaccacaacaaaactcctattttctgacacagaagggtgcaaatgtcatctccaggaagctgtgcctttccctgacagttaagcactcttctctgtgctaacctgaccatgctttcatagttgccatttcactatgaaatgtattttatacagtttcctcactatttgatcaatgagtttctcattagaaggggctgtgtcttattcactgcatcctatttcatacttaggaatatccaggcatatatagtggctgctaaataaatgttgaatgaacatagaccatggaagggcttgcagtagtagcatgagtggatgtgtgtgtaagagagagagagagaaaaagatgtgtgtgtaagagacagagagaaaaggatgtgtgtgtgtgagagagagagagagagaaaaggatgtatgtgtgttatgggtacaggcttgatgaaccagactcaaaatgctgtaagcttgaaatttggtctttgctttcatctttccctgttttcttcccagcactgggctcacttcctctcatttccatcgtgggatatgttgacggaggtatccagttactctgcctgtcctcaggctggttcccccagcccacagccaagtggaaaggtccacaaggacaggatttgtcttcagactccagagcaaatgcagatgggtacagcctgtatgatgtggagatctccattatagtccaggaaaatgctgggagcatattgtgttccatccaccttgctgagcagagtcatgaggtggaatccaaggtattgataggaggtgagtggggagaaggaggagcaaggaatgggtgtgtgcatacgtaacccagggtagagcagcagcttgtgtctgggattgttgtgtagtaccatccagcttcaatgatttgttttgagagtcaaagattgatgaggtataaaaaacaaaaccaaacatttgataaggcagaagtagaatagtttacaatttcaaggcagtagaattaagtatttccttcaccacacaatacccccatggtgcaacactcacaactcaacacgtaacaaaacttaaggaaattaactctaggactaagaaaataattgtttcttcatttttagaaaacgtcgttgctccttcatgaagcagaataaaactgtagaaaatttcagaaaggatttacaaatagtaggaaaatttacataaactaaaatgcttccagaatcacactcaattaaaaggattgaatttgccagttaaaagacaaagaatctcagactggatttaaaaatctcatcgcttgaacccaggaggcagaggttgcagtgagccgagatggcaccactgtgctccagcctgggtggcagagcaagactccatctcaaaaatgtaaaaataaaaataaaaataaaaatagacaaatactaaaaatctcaatggcaattcataagaggaaaaatgtagcacatatgagctattcattgaaaataaaaaatactcgagaaatattaatcacgaagaattgaacagatatattagtgtcaagaaaaggaagacaaagttgtaagaaaaagggcattagggatagagttatttcaaaaacataagttcactcagtataagaatatgaaaattttaaatatatatacatgtaccttatacatgtaaaacatagaaaatatcaacagaaataagaaaaaaggtcatacttcgagttctaaaattgattaaataagtagacaaaatgagtaagaatatatactatttgaactaaaaattaataagtctgaaataacgtatttttggagatggcactccaggtttgtagaatatacattaatttttaccacacttggaacttttataaaattttaccagatataaacacatacaatggttttaagaaaattttcagacatagatatcatgcacatgaaattctctaatcataatttaataaagtcaaatgaccacagcaaaagatagtttaaattcttatgtgtttgaaaaatttttaaacattaaaataactgagaaattgaagaaagcatagtgataggtagaaaattcttaaaactgaatgataataaaattacaatctatcataatgtgtaaaatagaactaatatagttttctgagtcaaaattttatctggccgggcgcagtggctcacgcctgtaatcccagcactttggaaggccaagacaggcggatcacctgaggtcaggagttcaagaccagcctggccataatggtgaaaccccgtctctactaaaaatacaaaaattagccgggtgtggtggcgggtgcctgtaatcccagctacctgggaagctgaggcaggagaattgcttgaacccgggaggcggaggttgcggtgagccgagatcatgccactgcactccagcctgggcgatagagcaagactccatctcaaaaatatatatatatatatcctttaatgcttaaatgttcttattagcatgaaatagctgaatattgatattaggcatcaatatatatttcagaaaacagcaaaagaaagtggaagaaatcctaaagatatagaaatatggaaatataaagacaaatagtgcacattaatacatctaaagttagacggttcgaagtgttattaaaatagataaactggcaacatcagttaagaataaaagagaaacagcacaattaaacaaggcaggaaataacaagaaggcacaactaaagatttagtagagatttgtaagataaactgctttgaataactttttccttttctattgaatatgatgaagtgaaagttttcatagaaaaatgtaaaatacaggacaggcgcagtggctcatgcctgtagtcccagcagtgtggaaggctgaggcgggcagatcgcttgaggtcaggagtttgagaccagcctgcccaacatggcgaaaccccatctctactaaaaatacaaaaattagctgggcgtggtggtgtgtgtctgtaatcccagctactctggaggctgaggctggagaatcacttaaatccaggagacagagattgcagtgagctgagatcgccccactgtactccagcctgggggacagagtgagactttgtctcaaaaatttttaaaaaagaagaaaaacgtaaaatacaaaatccgaaggaaagatagactacctgactaatttgtaaccatgaaagaggtggactcagcatttaaaagtcttcccacaaggaagacacaaggcccacattgttttatatacaaagtctaccaaatattcaagaaaagagaaaatgtatctttcagaaagtcggccagagagcagaaaaataggaaatattaaactcattttattgagtcaacataattttggtatcataagagaaatgggcaattcaaaaaaggaaaaatttttaccaacattactcataattgaaaatgtaaaaatcttaccaaaaattttgcaagtagaaaagtccacaaaaacatatatcatgaccaaacttatcctggaaaaaaatgttaggtcaacatgggaacatatattaatgtaattataacataattcgttaaaagagataaactataattttcttagtagatgtaaataaaacagataactttctacatctattcatcatgatttcaacacttgcaaatctagaaatagaagaaaattttttttatcaatctagaaataggagagactctgcttaatctgataaaaagatatctaaagatacttgcagcaaacatcatacaaaataataagccacctaattttttaaatacataccgaaaacattatacataatgtgtcatttaaaatcataacataggccgggcgcggtggctcacgcctgtaatcccagcactttgggaggccgaggcaggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaataaaataaaataaaaaaataaaataaaataaaataaaatcataacataaggagattgcattaaacacttctgttccacattatattagagtactgttactattagcagccacttcaataagggaagaaaatgtaaaagttataacttttagaaagaaaaaaattaaatggccattgttcacagtttatatgatgatataaacggaaaatttagaaaaatttacagacaaattctttcaactcataaaggaatccatcgtgttcatgaaaaatgagaggaataaacaaaatctaataaaatgtttacaaaatcttattgaagggtattataaaactgtattaaaagacactaatgaaaactaaaataagagaacaaacataacacctttcagataagaagatgcatgtttttaaagataccagttctcctagaattgctgtacagattcaatacaattccatagaaaaatctcagcacattttttggtttgtttgttttttgagatgagctgtcactctgtcacccatgctggagtatagtggtgcaatcatggctcattgcaacctcaatttcccatgctcaagcaatcctcccacctcagcctcccaagtagctgggaccacaggtgtgcaccaccatgcctggctaattttttttaattttaaatatttttatagatgggggggggtctcactttgttgcctagactggtctcgaactcctgtccttaagaaatcctcccggccaggcgcggtggctcatgcctgtaatcccagcactttgggaggccgagacgggaggatcacgaggttaggagatcgagaccatcctggctaacatggtgaaaccccatctctactaaaaatacaaaaaattagctaggcgtggtggcgggcgcctgtagtcccagccactcaggaggctgaggaaggagaatggcgtgaacccgggaggcagaggttgcagtgagccgagatcgcgccactgcactcctccctgggcaacagagcgagactctgtctcaacaaaacaaaacaaaacaaaacaaaacaaagaaatctaaaggagaaaagaataaacattacctttaaaaaaaaaaagaaatcctcccactttggcctcccaaactgctgggtttataggcatgagccactgcacctggcccagagttttcttaaagcctaacaagtcaattccaaagtttatgtggcaaaacaaatagccaagaattgctaagatacagtggaataagagcaagctaagaagcttagtcttatctcagagacatatcccaaagctttgaagattaagccaattaaaattattggcacagagataaccctatggatcaatgagagagaacaaagagcccagaaacaaatccaagcttgaacatgaggtacacagaggtgaccttgcatgtgtggcagtgtgtaaagcaaggtccactcaacaaacattgccagcacagtcaacacctgcttagaagaagatgacattgaacttctgcctcattagacatagacacacacacacacacacacacgtgtgtgtgtatatatatatatatatatatatatatgaaatccagatggatcaagacttataaagaaatgcaaagctttaacgcgcacacacacacacacgtgaatatatatatatatatatatatatatatatatatgaaatccggatggatcaagatgtttatagaaatgcaaagctttaaatctgtggaagaaatgagagaaaaatgttttcatcttggggtactgggggattccttaaatgggcgtaaaattgtcttacctgcttagctatcactaagggtctgtgggactgtttttcagagacgtttttccagccctcaccttggcgcctggcttctattttactcgggttactctgtggtgccctgtgtggtgttgtcatggggatgataattgttttcttcaaatccaaaggtaagtgagagagagaagcatgggcccataccttcttcatggttccagtggagctgatatcaggctgccctcacacacctctgggctctgctcttccagccctaggcctacaggggccaccagctgaggcacagggaacccagtcttcagcctcctctgtgctggcctgaaatggctccttcagaaaatgccagcctctgccaatccctttctactttacatggagcacaggataagcagataattgattttcagtacataaagagttcacataaatttctaccaacaggctgagtgccgtggctcgtgtctgtaatcccagcactttgggaggccgatgtgggaggatcacttgagcccaggagtgtaagaccatcctgggcaacatggcgagaactcctctctacaaaaaatttttaaaaaataaaataaaataattagctgggtgtggtggtgcgtgactgtggtcccagctacttaggaggttgagatgggaggatggcttgagcacaggaggtcaaggctttagtgagccatgttcgcaccactgcacatcagcctgggcaacagagtgagaccctgactcaataaataaatatataaaaataaataaatttctactaacgacaacaagagacaataagaaaatttcagggtggttgcaaagacttcatagaagaggaaataaaactgactgactgagataaaatgataatctcagtaagagtcttcaccctagaacaaatttcctcctccttgggagtgacacttccccttgggggtgaggccacccccgcctcccctcccagccgccttctcccatctccatccccacctccacagcatcccagctgttgtccctctccttagcatgcaccttcctgatctcttgctccaccccagagagccacactccgtgcaggggctggggagacgagcacatataagtgtcctaggagaggccctgcccttcacacctgcagctcgtcccacctgtgcaaggagccagcgtcgtgtttgtaccttgcacactcctgtgtccaccactgaatatactgtttctgtttcagggaaaatccaggcggaactgggtatgtgtcatgtcctgagcctcccacacatggttctcccgggtccctccctgatccacagtttgagcctctggacgaccctggctgcaggctggacaggaagcaccggcaggtggaggggagcagctgctcactctctccatccactgctcatgagttacccctcggacatctggagggcttaggataggccccggggcctggaagtccccacaaattgtctgtgcctgttgcccgttggtttgctgtgtgtgtggtggggggaggtgttgatcatgagctctgagggtgtctgggccacagtgaggaacctgagaaaaatttgtgggtgatcctcgacctcccctggcctgatgctttgagactttatccagttctgtatcaaccactaaatagtctgctttttgttttgtgggaactccaggataaactgggtgagagtgttaccactcgcagggattccctcccacgccctccctgggcccccgctctgtgacgtcagcctcttacatgttttttgtttttgtttttgtttttcagactggagaagaaagcacggacaggcaggtaaaagaaaatattcctcttcacacatttatgactcctttccaagtctctcgtttatggatttttatatcctgaggcccgtgggtccctgcagagccaagcttgtgatgggaactctgaaattgcagattctgggggaggtgcattttgtagagaagccccatagccttcttcagatctctggagggtccacaacactcaaaaagggtcccaatccttggtctttcccttctccctgcgccctgtttcccacgtgagcacggaactgcctgctctctctgcttgctttcagaattgagagacgcccggaaacacgcaggtaccaacgcctgagagggtaacagtgggcatggagtaggaagatgaccagtgacagatatggagcccatccagcttgtagacagcaaatctgtgatgcccgaatccaccccagggtgcagctgcctctaaatacacttcttggcccaggacttggagggaaaagcgtagggactgggtcagctaggaggggtcacaggcaagacgccagggaactgagggcattagtagctggcttctaggggtctgtgcaaaggggaactaagtgaagttagcaggaactggtgggtggaaggaagctgaatcctggagtcactcaaggtctcacaaagtcaaatagagggcttacgtgggagggcagtggtagggctgggtgaacatctcatggttgagcatctccaagcatcagtgaggcacgggggctgccctggagaaggtacatggctggtgggatagtgggactggccggatcctacccggagccagtctgcagtgggagggtcgacctcttgctccagcccagatttcgtcttcagtaactcatgcttcctctctcccccaccgcaccccagtggaggtgactctggatccagagacggctcacccgaagctctgcgtttctgatctgaaaactgtaacccatagaaaagctccccaggaggtgcctcactctgagaagagatttacaaggaagagtgtggtggcttctcagggtttccaagcagggaaacattactgggaggtggacgtgggacaaaatgtagggtggtatgtgggagtgtgtcgggatgacgtagacagggggaagaacaatgtgactttgtctcccaacaatgggtattgggtcctcagactgacaacagaacatttgtatttcacattcaatccccattttatcagcctcccccccagcacccctcctacacgagtaggggtcttcctggactatgagggtgggaccatctccttcttcaatacaaatgaccagtcccttatttataccctgctgacatgtcagtttgaaggcttgttgagaccctatatccagcatgcgatgtatgacgaggaaaaggggactcccatattcatatgtccagtgtcctggggatgagacagagaagaccctgcttaaagggccccacaccacagacccagacacagccaagggagagtgctcccgacaggtggccccagcttcctctccggagcctgcgcacagagagtcacgccccccactctcctttagggagctgaggttcttctgccctgagccctgcagcagcggcagtcacagcttccagatgaggggggattggcctgaccctgtgggagtcagaagccatggctgccctgaagtggggacggaatagactcacattaggtttagtttgtgaaaactccatccagctaagcgatcttgaacaagtcacaacctcccaggctcctcatttgctagtcacggacagtgattcctgcctcacaggtgaagattaaagagacaacgaatgtgaatcatgcttgcaggtttgagggcacagtgtttgctaatgatgtgtttttatattatacattttcccaccataaactctgtttgcttattccacattaatttacttttctctataccaaatcacccatggaatagttattgaacacctgctttgtgaggctcaaagaataaagaggaggtaggatttttcactgattctataagcccagcattacctgataccaaaaccaggcaaagaaaacagaagaagaggaaggaaaactacaggtccatatccctcattaacacagacacaaaaattctaaataaaattttaacaaattaaactaaacaatatatttaaagatgatatataactactcagtgtggtttgtcccacaaatgcagagttggtttaatatttaaatatcaaccagtgtaattcagcacattaataaagtaaaaaagaaaaccatatgatcatttcaacgatgcagaaaaaaagtttcataaagccaccatcattactgataaaacctgtcaacaaggaagatacatagatgaaaaataagcacaggaagagatacttaatgtcattaaacactaagaaaatgcaaactaaaaccacagcaagataccattaccatctattaaagtggctaaaattacaaagactgacaatagcaagtgttggtgaggatgtggagggaaggaattctcatacactgctcatgggactgtcaaataatatggtcactttggaaaacagttcagtagttcctttaaaagttcaacagtcactaaccatatgatccagcatggccttctaattatttttccaagagaaaaggaaatctgtgaatgttcatagcagctttatttgtaatagccaaaatttgaaaacaacacaaagctcaccaattgataacaaattatgatatatccatgcaaataaagtgctactcggaaataaaaaagaatattgttatacacacaaaatcattaaatctcacagaaattattacaagtagtgcttgctttggcagcacgtttagtaaaattggaatgatacagagattagcgtggcccctgcacaaggaggacatgcaaattcatgaagtgttccatattttaaatttaattttatgataaagaaaaacattggagggctgggcgtggtggctcacgcctgtaatcccagcactttgggaggccgaggtgggtggatcacaaggtcaggagactgagaccatcctggctaacatgatgaaaccccgtctctactaaaaatacaaaaaattagctgggcatggtggtggacacctgtagtcccagctactcgggaggctgaggcaggagaatggcgtgaacccagggggcggagcttgcagtgagccgagatggcgccactgcactccaacctgggcaacagagcgagactccgtctcaaaaaaaaaaaaaaaagaaaagaaaagaaaagaaaaacatgggaaggatctggcaagatgtctgaataggaacgctctggcctgccagcgagaccaatgcagaaggcaggggatttctgcatttccaactgaggtaccctgttcatctcattgggactggttaggcagtgggtgcagcccatggaaggcaggcagaagcagggcggggtgttgcctcaacccaggaagtgcaaggagtggggggcctccctccaccagccaagggaagctgtgagggactgtgctatctggcccagacactacgcgtttcccacggtttttgcaatccacagaacaggagagtccctcatgtgactacaccaccagggccctgggtttcaagcacaaaactgggtggctgtttgggcagacactgagccagctgcaggagtgtttttttataccctagtggcgcctggaaccacagcaagacagaactgttcaccccctggaaagggggctgaagctagggagccaagtgggctcactcagcgggtcccactcccacggagcccagcaagctaagagccactggcttgaaattcctgctgccagcacagtagtctggagctgacctggagcttggttgggggaggggcatctgtcattactggggcttgaataggtggttttcccctgacagtgctaaggaggcctggaagttcggactgggcggaactcaacacagcacggcaaagaggctgtggccagactgcctctctagattcctcctcactgggcagggcatctctgaaagaaaggcagcagtcccagtcaggggcttatagataaaagtcccaactcccttggacagagcacctgggggaaggggcggctgtgggtgcagcttcagtggacttaaacgttcctgcctgctggctctgcagagagcagcagatgctgacaaggagggctctcccagcacagcactcgagctctgctaagggacagactgcctcctcaagtgggtccctgacccctgtgtcacctgacggggagagacctcccaacaggggttgacagacacctcatacaggagagctctggttggcatcaggctggtgcccctctaagatgaagcttccagaggaaggagcaggcagcaatctttgctgttctgcagcctccactggttatacccaggcaaatagggtctggagtggacctccagcaaactgcagcagacctgcagaaaaggggtctgactgttagaagaaaaactaacaaacagaaagcagtaacatcaacatcaacaaaaggatccccacacaaaaaccccaaccacaggtcatcagcctcaaagatcaaaggtagataaatccacaaagatgaggaaaaaccagcttaaaaatgctggaaatttcaaaaatcagaatgcctcttccccaaatgatcataactcctgtctagtaagggcacaaaactggacagaaaatgagtttgaaagaattgccaaattgacagaagtaggcttcagcatatgggtaataacaaactcctctgaggtaagggagcatgttctagccaaatgcaaggaagctaagaacgttgacaaggttataggaatggctaactaggataaccagtttagaggagaacataaatgacctcatggagctgaaaaagacagcacgagaacttcgtgaagcatacacaagtatcaatagccgaatcgatcaagaggaagaaaggatgtgagagactgaagaacaacttactgaaatagggcatgaagacaagattagagaaaaagaatgaaaaggaacaaacaaagcctccaagaaatatgggagtatgtgaaaagaccaaacctatgattgatcagggtccctgaaagtgatggggagaatggaaccaagttggaaaacacacttcagaatattacccaggagaacttccccaacctagcaagacaggccaacattcaaattcaggaaatacagagaatgccacaaagatactcctcgagaagagcaaccccaagacacataatcgtcagattcaccaaggttgaaatgaaggaaaaaatgttaaggtcagccagagagaagggtcaggttacctacaaagggaagcccatcagatgaacagtggatctctctgcagaaaccctagaagccagaagagagtgagggccaatattcaacattcttaaaaaaattttcaacccagaattccatatccagccaaactaagcttcataaatgagggagaaatatagtcctttacagacaagcaaatgctgagggattttgtcaccaccaatcctgccctacaagagctcctgaaggaagcactaaatatggaaaggaacaactggtaccagccaccacaaaaacacaccagaatataaagaccaatgacactatgaaaaaactgcataaaggaatgtgcaaaataaccagcaagcgtcatgatgaccggatcaaatttacacataacaatattaaccttaaatgtaaatgggctaactgccccaattaaaagacacagactggcaaattggataaagagtcaagacccatcggtgtgctgcattcaggagacccatctcatatgcaaagacacacatcggctcaaaataaagggatggaggaatatttaccaagcaaatggaaagcaaaaagagcaggggctgcaatcctagtctctgataaaacagactttaaagcaacaaagacaaaggagggcattaaataatggtaaagggatcaatgcaataagaagagctaactatcctaaatatatatgcacctaatacaggagcactcagattcataaaagaagttcttagagacatacaaagagacttaggctcccacgcaataatagtgggagagtttaacaccccactgtcaatattagatcaacgagacagaaaattaataaggatattcaggacttgaactcagctctggaccaaacagacctaacagacatctacagaactctccaccccaaatcagcagaatatacattcttctaagaaccacatagcacttattctaaaatcggtcacataattggaagtaaaacactcctcagcaaatgcaaaagaacggaaatcataacagtctctcagaccacagtgcagtcaaattagaacccaggattaagaaactcactcaaaaccacacaattacatggaaactgaacaagctgctcctgaatgactactggatgaatgacaaaattaaggcagaaataaaaaagttatttgaaaccaatgagaacaaagacgcaacataccaaaatctctgggacacagctaaagcagtattaagagaaaaatttatagcactaaatgcctacagcagaaagtggaaaagatgtaaaattgacactctaacatcacaattaaaagaactagagaagcaagagcaaacaaattgaaaagctagcagaagacaagaaataattaatatcagagcagaagtgaaggagatagagacacaaaaaacccttcaaaaaaatcaatgaatccaggagttggttttgtgaaaagattaacaaaatagaccactagctagactaatatagaggaaaagagagaagaatcaaatagacacaataaaaaatgataaaggggatatcaccactgatcccacagaaatacaaactaccatccgagaatactataaacacctctatgcaaataaactagaaaatctagaagaaatggataaatttctggacacatacaccctcccaacactaaaccaggaagaaatcgaatccctcaatagaccagtaacaagttctgaaattcaggcagtaattaatagcctactaacaacaacaaaaagcccaggaccagacagattcacagaccaattctaccagaggtacaaagaggagctggtactattccttctgaaactattccaaacaatagaaaaagagggactcctccctaactcattttatgaggccagcatcatcctgattccaaaacctggcaaagacacaataaaaaaggaaaatttcaggtcaatatgcctaatgaacatctatgcgaaaatcctcaacaaaaatgggcaaatagaatccagcagcacatcaaaaagcttatccaccatgatcaggtgggcttcatctctggaatgaaagcctggttcaacatatgcaaatcaataaacataatcaatacataaagagaacaaatgacaaaaactacatgattagctcaacagatgcagaaaaggccttcaataaaattcaacgccccttcatgctaaaaattcttaataaactaggtatcgatggaaggtatcccaaaataataacagctatttatgacaaacccacagccagaatcatactgaatgggcaaaaactggaagcattccctttgaaaactggcacaagacaaggatgccctctctcaccactcctattcaacacagtaatggaagttctggcctgggcaatcaggcaagagaaagaaataaagggtattcagataggaaggcaggaaatcaaattgtctctgtttgcagatgacattattgtatatttagaaaaccccatcgtctcagcccaaaatctccttaagctgataagcaacttcagcgaaatctcaggatacaaaatcaatatgcaaaaatcaccagcattccaaatcaataaatgtaatccatcacataaacagaacctataacaaatccacatgattatctgaatagatgcagaaaaggcctttgacaaaattcaacacccttcatgctaaaaactctcaataaacttggtatcaatggaatgtatctcaaaacagtaacagctatttatgacaaacccacagccaatatcatactgaatgggcaaaaactgaaagcattccctttgaaaaccagcacaagacaaggatgccctctcttaccactcctattcaacatagtattggaagttctggtcagggcaatcaggcaagagaaagaaataaaaggtattcaaataggaaaagaggaagtcaaatagtctctatttgcagatgacatgactgtatatttagaaaaccccatcatctcagccccaaatctccttaagctgataagcaagttcagcaaactttcaggatacagaatcaatgtgcaaaaatcacaagcattcctgtacacaaataacagacaaacagagagccaaatcatgagtgaactcccattcacaattgctacaaagagaataaaatacctaggaatccaacttacaagggatgtgaaggacctcttcaaggacaactacaaaccattgctcaaggaaataagagaggacacaaatggaaaagcaatccatgctcatggataggaacaatattgtgaaaatggccatactgctcaaagtaatttatagattcaatgctatccccatcaagctaccactgactttctttacagaattggaaagaactactttaactccatatggaaccaaaaaagagcccgcatagccaagacaatcctgggcaagaagaacaaagctggaggcatcatgctacctgacttcaaacaatactacaaggctagctacagtaacaaaaacagcatggtaccggtaccaaaacagatacttaggccaatggaacagaacagagaggcctcagaaataacatcacacatctacaaccaactgatctttgacaaacctgacacaaacaagcaatggggaaaatattccctgtttaataaatggtgctgggaaaactggctagccatatgcagaagcctgaaactggaccccttcctcacaccttatacaaaaattaactcaagatggatcaaagacttaaacgtaagacctaggtccataaaaatcctagaagaaaacctgggcaataccattcaggatgtaggcatgggcaaagactttatctctaaagcaccaaaagcaatggcaacaaaaaccgaaattagaatttctctgatgactagtgatgatgagcattttttcgtgtgtccgttggctgcataaatgtcttcttttgagaagtgtctgttcatatcctttgcccactttttgatggggttgtttgttttcttcttgtaaatttgtttaagttctttgtagattctggatatcagccctttgtcagatggatagattgcaaaaattttttcccattctgtaggttgcctgatcactctgatggtagtttctcttgctgtgcagaagctctttagtttaattagatcccatatgtcaattttggcttttgttgcccttgcttttggtgttttagtcatcaagtctttgcccatgcctatgtcctgaatgatattgcctaggttttcttctagggattttatggttttaggtctaaaatttaagtctttaatccatcatgaactaatttttgtataaggtgtaaggaagggatccagtttcaactttctacatatggctagccagttttcccaacaccatttattaaatagggaatccttttcccactgcttgtttgtgtcaggtctgtcaaagatcagatggttgtagatgtgaggtgttatttctgaggcctctgttccattccattggtctatatatctgttttggtaccagtaccatactgtagccttgtagtatagtttgaagtcaggtagagtgatgcctccagctttgttcattttgcttaggattgtcttggctatgcaggctctttctttggttccatatgaactttaaagtagttttttccaattctgtgaagaaagtcattggataccatctcaggctggttagaatggtgatcattaaaaatcaggcaacaacagatgctaaagaggatgtggagaaataggaatgcttttacactgttggtgggagtgtaaatttgttcaaccattgtggaacacagtgtggtgattcctcaaggatctagaactagaaataccatttgactcagcgatcccattactgggtatatacccaaagaattataaatcatgctagtataaagacacatgcacatgtatgtttattgtggcactattcacaatagcaaagacttggaacccacccaaatgtccatcaatgacaggctggattaagaaaatgtggcacatatacaccatggaatactatgcagccataaaaaaggatgagttcatgtcctttgcagggacatggatgaagctggaaaccaccattctcagcaaactatcacaaggatggaaaatcaaacaccacatattctcactcataggtgggaactgaacaatgagaacacttggacacagggtggggaacatcacacactggggcctgtcaggggttagggagctgggggagggatagcattaggagaaatacctaatgtaaatgatgagttgttgggtgcagcaaaccaccatggcacatgtatacatatgtaacaaacctgcacattgtgcacatgtaccgtagaacttaaaatataatttaaaaaacaaaaaaacaaaattgacaaatgggatctaattaaactaaagagcttctgcatagcaaaagaaactatcatcagagttaacaggcaacctacagaatgggagaaaaattttgcaatctatccatctgacaaagggcaaatatccagaatctacaaagaacttaaacaaatttacaagaaaaaacaaacaaccccatcaaaaagtgggcaaagtatatgaacagaaacttctgaaaagaagactttaatgcagccaacagacatatgaaaaaattctcatcatcgctggtcatttagagaaatgcaaatcaaaaacaacaatgagatactatctcaggccagttagaatggcaatcattaaaaagtcaggaaacaacagacgctggataggatgtggagaaatagaaacatttttacattgttggtgggagtataaattagttcaaccattgtggaagacagtgtggtgattcctcaaggatctagagctagaaataccatttgacccagcaatcccattactgggtatatacccaaagaattataaatcattctactataaagacacatgcacatgtatgtttattgcagcacaattcacaatagcaaagacatggaaccaacccaaatatccatcaataatagactggataaagaaaatgtgccacgtatacaccatggaatactatgcagccataaaaaaaggatgagttcatgtcctttgcagggaccggatgaagctggaaaccaccattctcagcacactatcagaagaacagaaaaccaaacactgcattttctcactcgtaagtgggagttgaacaatgagaacacaaggacatagggaggggagcatcacataccagggcctgtcaggaggtggggggctaggggagggatgacattaggagtgatacttaatgaaggtgatgggttgataggtgcagcaaaccaccatggcatgtgtatacctatgtaacaaaactgcgcattctgcccatgtagcccagaacttaaagtataataataaaaaaaaatcaccagcattcctatacacaaaaaataaacaagcagaaaaccaaatcatgagtgaactctcattcacaattgctacaaagaaaataaaatacctaggaatacaacttacaagggacatgaaggaactcttcaaggagaactacaaaccactgctcaaggaaataagaaaggacaaaaacaaatggaaaaaacattccatgctcatggataggaagaatcaatatcatgaaatggccatactgcccaaagttatttatagattcaatgctactcccatcaagctaccattaactttcctcatagaactagaaaaaactactttaaatttcatatggaacctaaaaagagcccgtatggccaaggcaatcctaagcaaaaagaacaaagttggaagcatcatgctacccgactacaaggctacagtaacaaaaacagcatggtactggtaccaaaacagatatatagaccaatggaacagaacagatgccccagaaaaacaccacacatctacaaccatctgatctttgacgaccctgagaaaaacaagcaatagggaaaggattccctatttaataaatggttctgggaaaactggctagccatatgcagaaaacaaaaactggaccccttgcttacatcttttaactcaagatggattaaagacttaaaagtaaaacctaaaaccttaaaaatcctagaagaaaacctaggcaatatcattcaggacagaggcctgggcaaagactttatgactaaaacaccaaaggcaattacaacaaaagccagaattgacaaatgagatctaattaaactaaagaacttctgcacagcaaaagaaactatcatcagagtgaacaggcaacctacagaatgggagagaatttttgcaatctatccatctgacaaagagctaatatgcagaatctacaaggaacttaaacaaatttacaagaaaaaaaaaaaaacaaccccatcaaaaagtgggcaaaaagaagacatttatgcagccaacacacatatgaaaaaaagcccaacatcactggtcattagagaaatgcaaatcaacaccacaatgagataccatctcatgccagttagaatggcaatcattaaaaagtcaggaaacaacagatgctaaagaggatgtggagaaataggaacgcttttacactgttggttggagtgtaaattagttcaaccattgtggaagacagtgtggtgattcctcaagggtctagaaccagaaataccatttgacccagccatcccattactgggtatacacccaaaggattataaatcattctactataaagacacatgcacatgtatgtttactgcagcactatttacaataacaaagacttggaaccaacccaaatgcccatgaatgatagactgaataaagaaaatgtggcacatatacaccacggaatactatgcagccataaaaaggaatgaactcatgtcctttgcggggacatggatgaagctggaaaccatcatcctcagcaaactaacacaggaaccaaacactgcacattctcactcataagtgggagttgaacaatgagaacacatggacagaggaaggggaacgtcacacaccagggcctttcagggggtggagggggaaaggggagggagagcattagggcaaatatctaatgcatacggggcttaaaacctagatgatgggttgataggtgcagcaaaccaccatggcacatgtacacctacgtaaggaacctgcatgttcagcacatgtatcccagaacttaaagtaaaattgtttttaaaaaagtttttttaaattattccaagtaaaaagagacagactccctcccaagatattgtctgactcaatttacgttaaaactctagaaaatacaaactagtttatagtgacatagggcaaatcagtacttgcttgaaggggagattagtgtaggagggattacaaagggcaaaaggatgatgtggggcatgatggatatgtttactattttgttagtggatggttcatggacatcagttaaatactttatatgtatacagcttattttatctcagttattctcctgttttaaaaataaattattaaacactaataacaactgaagggagatctggttgatcatagtgattggtattagctaaacactgtcctttcagtgctatgattatatctttgttttaatagacttcattttttagagtagtttaagattcacagaaaaactgagcagaaagtacagagttctcatatactccttgcccccacatgtatacctccctcaccatcaacatcctgtaccacaatggtacatttgtcacaattagcgagcctatatgtatacattattatcactcaaagtccactgtttccattatactcttggtgctgtacattgtatggattttgacaaatgcataatgatgtgtatttgccattatcgtattatatagagtactttcattgccccaaaaatattctgtgctctgcctattcatctgtccctcaccatgaatctctggcaacctctgatctttctactgtcaccaaagttttgctttttccagaatatcatagtgttggaatcatagaatatgtagccttttcagattggcttctttcacttggtaatatgaacattcactttttaaccatagtactgtatttgatatacagctacatatgtaattattttatttcaagtctatgtttgtgagcccctggttagctgagtgtagacattctcaagagggggaaagggatgtggcc

SEQ ID NO: 15 - DNA, 4183 bp, Homo sapiens
aaaatccagttttgtgttatcagtccttagaaaaagatttatgagttaaaatgcagcagaggccaggtgcagtggctcccatctataacgccagcactttgggaggctgagggggataggattgcttgaagccaggagttcgagaccagcctgggcaacataatgagaccctgtatctacagaaaatttttaaaaacaagccagtcatggtggtgtgcgcctgtagtcccaggtacttaggaggctaaggtgaaaggatcacttgagcccaggggttcaagggtacagcgaggcctatgatcacaccgctgcattcctgcctggctgacagtgagaccctgtctctaaaaataattaaaattcaaaatgtggtagagacactagaaggaaaaatgattctgcttctcccagcattctgcctctgcataattgagttagtgcatttcataggtcaagaactatttaaattacacctgcatattttagtcctgcatatttcttcataagagagaaaagcatctaataaatacaatgaaatttcattcatgtctttatttaagggatgaataaaatgtcacagtacctaatcgtatacatcaattatggatccagatttaattctggctgtgcctctttggaaaggcagctgatgagcaagacatcactgatcaaaaactgcattctgttagagcaggagctgacagggaacctagatgccagcatttccatgccctgcctgatgtttaccatttgatcacgttcgaactgaggaatgaggcttatcggattttatgttgctttttttagatgaatgctcttggctttttgttgttgttatggttacttcccattgatttattccactaaccatttagactcccgttcattcacctacggccaaatgggactagaatggaaaaacggaatcctacccgatcaatgcaaattctatttctctctctccaagaggcccagatgaccagccctgacactgggagccactgggagcttcaggtgctggcccagcagtgcctggccatgttttcaagtgtacatcaggtgaccactcacctgttgtacttcagtctgattttccaaggagtatttaaaaccacccaggcagtgatttcaaaccgactttctacttattccacaaggtaccgtcgaaccactgttctacgtgtgaggcctgtggagggtttatacagcaatgagtgttcagtgttaagtcctgccttccttcatagaagagaaatttatcagttcctctgggtgtcagttttagagcaatacaacaacgttttgaaagacaaatccatttttaatgagacggacagattttcaggtaatagtactgctagaaataacatataatgatctactggttctgaatacactgctgaattcctgaatacgctgaagacctccccctcctctttcctggttatgttctgcacctgtttacactatgaagctgaaaaacaaactttgactatagctaactatgattgttctaatttccatagtacttgatcccctcccacacaccaaactatgaatgacagactgctgaatagatggtttcagtcatagaccgtccctgacttatggttccacttagaagttttcaactttaccatggttcaaaagtgatatgcgttcagtagaaaccgtactttgaatacccatacaaccattctgttttccactttcaacactttattataaaataggtgtgttagatgactttactgaactgtagactaatgtaagtgttctgagtatgtttaaggtaggctgggctatgctatgatgttcagtaggttacgtgtatttaatgcatttttgatttacaatattcccaccttacgatgggtgtatggggaggtaaccccattatacgttgaaaagcatctgtatattcattcctacagtcactggtgattactttgtccaaggcattattttgggggaacacaaagagaagtgacatttagtcccagctgtcaagaaaactttaattctaggaaaggcacagttgcgggcctctggcccatccgaagagagcaggaacacacctggtccagttaggtagagccgggagcagaatccaggaggaagccccactcagcgggggtctctggtgttctaaagtgatggatagtgactggtactaagtgtgaggggagagggtggattacacctgaatagtacagaggctctaaggcagaacatccagggacttagagagacgtcaaactcctccacaacaatgttccccaaacaagagtcatttgaggaccaatgtcacgatttttgccatttctgatgacatttttaccatttctagtggcctcctttactgttgtttacttaacattttcctttaaatggactcactatttttacttaaataaatttatgttaaaaagtttatgttaaagagaaattttgcaatactaccatgaaatgaaatgccagtaccgcttgctgtcacgatacggtggtgctaaaaatacgtaatataaaaatataatgaaactcagcactgttgcccaccgaagcatccaggtctgaggtctgacctctctttgttaaaaagggaaaatagcaagtattggcaccataataaagatagtccagccccacactgagccggcctgagactctgagaaattgaaagggaatcggggaaggaataagactggatgttatttagctcccagtctgtgaattacctaaagacccccagtgccaccagtgcgacatacttcaccccagaacagagggaaggaacagaatggtaggcagtgctttggggccagttgtactacagtctctgcagagcaaccatatgctgtgtcagggctggaaccaggtttggccatctgtgttgaccccacagattctatgaagggtgacttccacaatccctagcacactggggagcacacagtacatacttatcaaaagtcttaaattaagtctcactgatgccctaaaatcttctgcctgtttcataaaaagtagaaaatgaagttgacagtgattctttgtatctcataatatcacatcgccctccccaaaaaggaacattgatagaaaactataagatataaaacctaacaaaaatcatctggtgaatagatcccatggaatacacaagaagaagatataggtgcatttaaataatctcaaaggaaaagaagaaatctcctttgagaagtcacatctaaatgcttatccaggctgggcacagtggctcatgcctataatcccagcactctgggaggccgaggtgggtggatcgcttgagcctagttgtttgggaccaacctgggtaacataacaaaaccccgcctctacaaaaaaatactaaaaaaaaaaattagtcgggcatggtagcacacgagtgtggttccagctactcaaagaggctgaggtgggaggattgcttgagcccgggaggttgaggctgcagtgagctgagattgtgccttgcactccagcctggatgacagagtaagaccctgtctcataaataataaataaataaatccctgtccaaataaataaatgcttatccaatcgctgaaaaggagctcaagcatgtacacgaggccccaagcacagctctgtcctccgtggagctggctttattctcccagtgtttcctgctcaggtgcccttttctctttcatttctcacaacactcccgcctctcacttggcattcagtaactgaacaaggagcgggaaagcatgctaatgcatcgcaaatggagttgctgcatttccttaaaaggactgtcatgagcatttcattttaacgtattacccggaattgtgtcagtgttttaagtgaactattttctgtaatccatatcgttatgaatataagacattaacgtactgattgccacttgagaatctcattttaaagtgattgtactgcatttctaaaatttgcatttttaaagcaagtttcccccacaaataacaccttacccaagacacctccaggcagaacgttgtttcttacagtaaatgatattttaatatttggtttcagtagagaccagtctaatcaattatagagtaacatactttacttgtaataaattcaaaaaagtgatagctatactgtcatttgtagatgttcttaagaaatatggaatcttatt

SEQ ID NO: 16 - DNA, 5838 bp, Homo sapiens
aaaatccagttttgtgttatcagtccttagaaaaagatttatgagttaaaatgcagcagaggccaggtgcagtggctcccatctataacgccagcactttgggaggctgagggggataggattgcttgaagccaggagttcgagaccagcctgggcaacataatgagaccctgtatctacagaaaatttttaaaaacaagccagtcatggtggtgtgcgcctgtagtcccaggtacttaggaggctaaggtgaaaggatcacttgagcccaggggttcaagggtacagcgaggcctatgatcacaccgctgcattcctgcctggctgacagtgagaccctgtctctaaaaataattaaaattcaaaatgtggtagagacactagaaggaaaaatgattctgcttctcccagcattctgcctctgcataattgagttagtgcatttcataggtcaagaactatttaaattacacctgcatattttagtcctgcatatttcttcataagagagaaaagcatctaataaatacaatgaaatttcattcatgtctttatttaagggatgaataaaatgtcacagtacctaatcgtatacatcaattatggatccagatttaattctggctgtgcctctttggaaaggcagctgatgagcaagacatcactgatcaaaaactgcattctgttagagcaggagctgacagggaacctagatgccagcatttccatgccctgcctgatgtttaccatttgatcacgttcgaactgaggaatgaggcttatcggattttatgttgctttttttagatgaatgctcttggctttttgttgttgttatggttacttcccattgatttattccactaaccatttagactcccgttcattcacctacggccaaatgggactagaatggaaaaacggaatcctacccgatcaatgcaaattctatttctctctctccaagaggcccagatgaccagccctgacactgggagccactgggagcttcaggtgctggcccagcagtgcctggccatgttttcaagtgtacatcaggtgaccactcacctgttgtacttcagtctgattttccaaggagtatttaaaaccacccaggcagtgatttcaaaccgactttctacttattccacaaggtaccgtcgaaccactgttctacgtgtgaggcctgtggagggtttatacagcaatgagtgttcagtgttaagtcctgccttccttcatagaagagaaatttatcagttcctctgggtgtcagttttagagcaatacaacaacgttttgaaagacaaatccatttttaatgagacggacagattttcaggtaatagtactgctagaaataacatataatgatctactggttctgaatacactgctgaattcctgaatacgctgaagacctccccctcctctttcctggttatgttctgcacctgtttacactatgaagctgaaaaacaaactttgactatagctaactatgattgttctaatttccatagtacttgatcccctcccacacaccaaactatgaatgacagactgctgaatagatggtttcagtcatagaccgtccctgacttatggttccacttagaagttttcaactttaccatggttcaaaagtgatatgcgttcagtagaaaccgtactttgaatacccatacaaccattctgttttccactttcaacactttattataaaataggtgtgttagatgactttactgaactgtagactaatgtaagtgttctgagtatgtttaaggtaggctgggctatgctatgatgttcagtaggttacgtgtatttaatgcatttttgatttacaatattcccaccttacgatgggtgtatggggaggtaaccccattatacgttgaaaagcatctgtatattcattcctacagtcactggtgattactttgtccaaggcattattttgggggaacacaaagagaagtgacatttagtcccagctgtcaagaaaactttaattctaggaaaggcacagttgcgggcctctggcccatccgaagagagcaggaacacacctggtccagttaggtagagccgggagcagaatccaggaggaagccccactcagcgggggtctctggtgttctaaagtgatggatagtgactggtactaagtgtgaggggagagggtggattacacctgaatagtacagaggctctaaggcagaacatccagggacttagagagacgtcaaactcctccacaacaatgttccccaaacaagagtcatttgaggaccaatgtcacgatttttgccatttctgatgacatttttaccatttctagtggcctcctttactgttgtttacttaacattttcctttaaatggactcactatttttacttaaataaatttatgttaaaaagtttatgttaaagagaaattttgcaatactaccatgaaatgaaatgccagtaccgcttgctgtcacgatacggtggtgctaaaaatacgtaatataaaaatataatgaaactcagcactgttgcccaccgaagcatccaggtctgaggtctgacctctctttgttaaaaagggaaaatagcaagtattggcaccataataaagatagtccagccccacactgagccggcctgagactctgagaaattgaaagggaatcggggaaggaataagactggatgttatttagctcccagtctgtgaattacctaaagacccccagtgccaccagtgcgacatacttcaccccagaacagagggaaggaacagaatggtaggcagtgctttggggccagttgtactacagtctctgcagagcaaccatatgctgtgtcagggctggaaccaggtttggccatctgtgttgaccccacagattctatgaagggtgacttccacaatccctagcacactggggagcacacagtacatacttatcaaaagtcttaaattaagtctcactgatgccctaaaatcttctgcctgtttcataaaaagtagaaaatgaagttgacagtgattctttgtatctcataatatcacatcgccctccccaaaaaggaacattgatagaaaactataagatataaaacctaacaaaaatcatctggtgaatagatcccatggaatacacaagaagaagatataggtgcatttaaataatctcaaaggaaaagaagaaatctcctttgagaagtcacatctaaatgcttatccaggctgggcacagtggctcatgcctataatcccagcactctgggaggccgaggtgggtggatcgcttgagcctagttgtttgggaccaacctgggtaacataacaaaaccccgcctctacaaaaaaatactaaaaaaaaaaattagtcgggcatggtagcacacgagtgtggttccagctactcaaagaggctgaggtgggaggattgcttgagcccgggaggttgaggctgcagtgagctgagattgtgccttgcactccagcctggatgacagagtaagaccctgtctcataaataataaataaataaatccctgtccaaataaataaatgcttatccaatcgctgaaaaggagctcaagcatgtacacgaggccccaagcacagctctgtcctccgtggagctggctttattctcccagtgtttcctgctcaggtgcccttttctctttcatttctcacaacactcccgcctctcacttggcattcagtaactgaacaaggagcgggaaagcatgctaatgcatcgcaaatggagttgctgcatttccttaaaaggactgtcatgagcatttcattttaacgtattacccggaattgtgtcagtgttttaagtgaactattttctgtaatccatatcgttatgaatataagacattaacgtactgattgccacttgagaatctcattttaaagtgattgtactgcatttctaaaatttgcatttttaaagcaagtttcccccacaaataacaccttacccaagacacctccaggcagaacgttgtttcttacagtaaatgatattttaatatttggtttcagtagagaccagtctaatcaattatagagtaacatactttacttgtaataaattcaaaaaagtgatagctatactgtcatttgtagatgttcttaagaaatatggaatcttattccagacaggcatttctataactttgtggtgctatcaatgatgctaatgaagatttgacatcagttcaccacatttttgaaaatcaaattgttggctcagccgctaatgaaacacaatctcaaagcagttttaacaaccatttacattttttctgaaaacctcactctaccgtttctatggggtccctgactagaaatatcaaaagtctacatgaatataaaacaatatagtctatttttcaaagagaaattgagactgatgcaaaatatttgacttcttttttttttatatgaaacataaatgtttattcattggcaaagccttaacttctctaagcctcgtttccctcatctgtcacttggcgggtaatcctatttagctcagagggttaccaggagacttaatgggatactgcataataagtactaagcacagtgccccccatcatgtactgcccttggtctgtgctctaatattgaagcaggatgcttccctgaccgctttgtgggacttgcaacaggggtgccctcaattacccagcccacagctttcaactcctcatgggaggaagcacgcatgtgaatgaggcaggaactggagtgcatgaatgctgaaaccagccagccacttaggtactgccaggagcaaacgccactcacttggacccactgtgctccaccccttgcaggggtaagcacgcgggtgagtgggtgcaggagccagggtgagcgcttttgagcgccaacaggagtgaactctgtgcaggctccgtggcagcatctaggggtggtgcctgcaacccctgaagccccagagggcatgttacagtgcttttagttctgctgtccccagacagcctaagtatcaacagctcagtggcttttcacgtaagctggctgccttctgccagtgagtacaaagggcaagtgtgacagccttttgtagccacactagcagcatccgagctcttgtcccacatccaggagaaatgacatcacacaaattgaaggatgacaaatgtaggggatttttattgccgatgaaagtggctctcagcaggaagggaagttgaaaaggggatggagagggaaggtaatcttctcctgaagtccagccatctctggccagattcttctctgatgttacgtgtcaagctgtccctctgaagtgaagctgcttctctccaatgtctaaccatagtcaccaacgtccagctgcttctcttctctctgccagctgagtatggggtttttataggcacaggatgtcagggggcaggcccatgggtggttttggaaaaggcaacatttgagctggaaaacagggatgtaagttctcactttgggctgcagtttctggcttgagggtgagggtttgacagggacccgcccctttctgcctagattttctctgccacctttctctaccattgtatcaatattattatcacatggccctgagttggaaccatcaggtcctgcaaactccagagcatctacttactgcacattggcccccccccaggggaattggtcccagccaagggtctctaggaaagaggcacatcaactagatgtggaacacactccggttttggaagtactggttctgttctccagggcatcagaatcctcctttttgtgaccctgctgcct

SEQ ID NO: 17 - DNA, 7673 bp, Homo sapiens
acaaaaatttgctaacacacttttcctagcctacactttgttatgctgcttgtgaaatgtatgaggtcaacacctttctacccttttttccccattgtcgcaaattctcctgctgtccagagttagtttcaaatgaccctctgctagtcttggccggcatacctaccagtggcttggagaggaattaaggaaaagcttgaaaactgaagctcatttttttgtatggtgttggctagagtttaacgtggttctccaaagccaaaaaaacattttagcagaagcggagcacacacagagataaattatttttctgtactacatttcagttggtaatttcgtacacaggattctatttctgctgctatcaagataaaatgcaaaagtggaaacattccaatgagtaagaagcaggtctgttcattcccagctcatgagaaactcaggacgcacattagtgttctgtttcccagcagcaaatagccaggacatatagcttcaatttactgggattcgaagaagtcaaatcagacctgatttcccatgaagtaaatcatagcacccagctctgtggtttgagtgacaggtacatccattattctgaaaggtcttgttactttcagcagagcttgttattcttagccctaaaaaatcatgccatgtgacagggcacctgaggctgaggaatggggcaccagcaccttccaggctttctatcttacatctgacaacttgaaacatccaggaaagaagtggaaaatccacatatcagatgtgtgctcctacccattccaaatgtctggtgtttgggaaacatttaagggatcataaattctcttttgtgtcaatgtttttggtactgtgtaattacaactatatatgtatagttatgtatatatgtatgttatactatatataaaactatatatagttacatatatgtatatatacaactatataaatatataaactataaatataaaatataaatatatatatttttatatatatatagtatattatatatatacaattttttttgagacagagtcttgccctgtttcccaggcttgagcgcaatgccgtgatctcggctcactgcaacctctgcctcccaggttcaagtgattctcttgcctcagcctcccgagtagctgggattacaggcgtccaccaccacgcccagctaattttttgtatctttagtagagatggggtttcaccatgttggccaggctggtctcaaactcctgacctcgtgatccacctgcctcggcctcccaaagtgctgggattacaggcgtaagccaccatgcccggccattacaactatattctaagattaactagcaatcataagttttttgttttcagtctagattttagaaatgcgaatgacaccaggcccaacactttgggaggccgaggcaggtggatcacgaggtcaggagttcaagaccaacctggccaagatggtgaaaccccctctctactaaaaatacaaaaaaaaaaaaattagccagacatggtggcgggcgcctgtaatctcagctattcgggaggctgatgcagagaattgcttgaacctgggaggtggaggttgcagtgagccgagattgcgccactgcactccagcctgggtaacagagcaagactccatctcaaaaaaaaaaagaaaaaaagaaacgtgagtgacaatttcaacctatttagtatccccaaaagctcaggagctgtgataaattgatacaaataaaaatgtaatacttcatctttttgcaaaatagtgcagtgggctctatgaagacatttctttttattgttgactctggaaagaaaaaatccagttttgtgttatcagtccttagaaaaagatttatgagttaaaatgcagcagaggccaggtgcagtggctcccatctataacgccagcactttgggaggctgagggggataggattgcttgaagccaggagttcgagaccagcctgggcaacataatgagaccctgtatctacagaaaatttttaaaaacaagccagtcatggtggtgtgcgcctgtagtcccaggtacttaggaggctaaggtgaaaggatcacttgagcccaggggttcaagggtacagcgaggcctatgatcacaccgctgcattcctgcctggctgacagtgagaccctgtctctaaaaataattaaaattcaaaatgtggtagagacactagaaggaaaaatgattctgcttctcccagcattctgcctctgcataattgagttagtgcatttcataggtcaagaactatttaaattacacctgcatattttagtcctgcatatttcttcataagagagaaaagcatctaataaatacaatgaaatttcattcatgtctttatttaagggatgaataaaatgtcacagtacctaatcgtatacatcaattatggatccagatttaattctggctgtgcctctttggaaaggcagctgatgagcaagacatcactgatcaaaaactgcattctgttagagcaggagctgacagggaacctagatgccagcatttccatgccctgcctgatgtttaccatttgatcacgttcgaactgaggaatgaggcttatcggattttatgttgctttttttagatgaatgctcttggctttttgttgttgttatggttacttcccattgatttattccactaaccatttagactcccgttcattcacctacggccaaatgggactagaatggaaaaacggaatcctacccgatcaatgcaaattctatttctctctctccaagaggcccagatgaccagccctgacactgggagccactgggagcttcaggtgctggcccagcagtgcctggccatgttttcaagtgtacatcaggtgaccactcacctgttgtacttcagtctgattttccaaggagtatttaaaaccacccaggcagtgatttcaaaccgactttctacttattccacaaggtaccgtcgaaccactgttctacgtgtgaggcctgtggagggtttatacagcaatgagtgttcagtgttaagtcctgccttccttcatagaagagaaatttatcagttcctctgggtgtcagttttagagcaatacaacaacgttttgaaagacaaatccatttttaatgagacggacagattttcaggtaatagtactgctagaaataacatataatgatctactggttctgaatacactgctgaattcctgaatacgctgaagacctccccctcctctttcctggttatgttctgcacctgtttacactatgaagctgaaaaacaaactttgactatagctaactatgattgttctaatttccatagtacttgatcccctcccacacaccaaactatgaatgacagactgctgaatagatggtttcagtcatagaccgtccctgacttatggttccacttagaagttttcaactttaccatggttcaaaagtgatatgcgttcagtagaaaccgtactttgaatacccatacaaccattctgttttccactttcaacactttattataaaataggtgtgttagatgactttactgaactgtagactaatgtaagtgttctgagtatgtttaaggtaggctgggctatgctatgatgttcagtaggttacgtgtatttaatgcatttttgatttacaatattcccaccttacgatgggtgtatggggaggtaaccccattatacgttgaaaagcatctgtatattcattcctacagtcactggtgattactttgtccaaggcattattttgggggaacacaaagagaagtgacatttagtcccagctgtcaagaaaactttaattctaggaaaggcacagttgcgggcctctggcccatccgaagagagcaggaacacacctggtccagttaggtagagccgggagcagaatccaggaggaagccccactcagcgggggtctctggtgttctaaagtgatggatagtgactggtactaagtgtgaggggagagggtggattacacctgaatagtacagaggctctaaggcagaacatccagggacttagagagacgtcaaactcctccacaacaatgttccccaaacaagagtcatttgaggaccaatgtcacgatttttgccatttctgatgacatttttaccatttctagtggcctcctttactgttgtttacttaacattttcctttaaatggactcactatttttacttaaataaatttatgttaaaaagtttatgttaaagagaaattttgcaatactaccatgaaatgaaatgccagtaccgcttgctgtcacgatacggtggtgctaaaaatacgtaatataaaaatataatgaaactcagcactgttgcccaccgaagcatccaggtctgaggtctgacctctctttgttaaaaagggaaaatagcaagtattggcaccataataaagatagtccagccccacactgagccggcctgagactctgagaaattgaaagggaatcggggaaggaataagactggatgttatttagctcccagtctgtgaattacctaaagacccccagtgccaccagtgcgacatacttcaccccagaacagagggaaggaacagaatggtaggcagtgctttggggccagttgtactacagtctctgcagagcaaccatatgctgtgtcagggctggaaccaggtttggccatctgtgttgaccccacagattctatgaagggtgacttccacaatccctagcacactggggagcacacagtacatacttatcaaaagtcttaaattaagtctcactgatgccctaaaatcttctgcctgtttcataaaaagtagaaaatgaagttgacagtgattctttgtatctcataatatcacatcgccctccccaaaaaggaacattgatagaaaactataagatataaaacctaacaaaaatcatctggtgaatagatcccatggaatacacaagaagaagatataggtgcatttaaataatctcaaaggaaaagaagaaatctcctttgagaagtcacatctaaatgcttatccaggctgggcacagtggctcatgcctataatcccagcactctgggaggccgaggtgggtggatcgcttgagcctagttgtttgggaccaacctgggtaacataacaaaaccccgcctctacaaaaaaatactaaaaaaaaaaattagtcgggcatggtagcacacgagtgtggttccagctactcaaagaggctgaggtgggaggattgcttgagcccgggaggttgaggctgcagtgagctgagattgtgccttgcactccagcctggatgacagagtaagaccctgtctcataaataataaataaataaatccctgtccaaataaataaatgcttatccaatcgctgaaaaggagctcaagcatgtacacgaggccccaagcacagctctgtcctccgtggagctggctttattctcccagtgtttcctgctcaggtgcccttttctctttcatttctcacaacactcccgcctctcacttggcattcagtaactgaacaaggagcgggaaagcatgctaatgcatcgcaaatggagttgctgcatttccttaaaaggactgtcatgagcatttcattttaacgtattacccggaattgtgtcagtgttttaagtgaactattttctgtaatccatatcgttatgaatataagacattaacgtactgattgccacttgagaatctcattttaaagtgattgtactgcatttctaaaatttgcatttttaaagcaagtttcccccacaaataacaccttacccaagacacctccaggcagaacgttgtttcttacagtaaatgatattttaatatttggtttcagtagagaccagtctaatcaattatagagtaacatactttacttgtaataaattcaaaaaagtgatagctatactgtcatttgtagatgttcttaagaaatatggaatcttattccagacaggcatttctataactttgtggtgctatcaatgatgctaatgaagatttgacatcagttcaccacatttttgaaaatcaaattgttggctcagccgctaatgaaacacaatctcaaagcagttttaacaaccatttacattttttctgaaaacctcactctaccgtttctatggggtccctgactagaaatatcaaaagtctacatgaatataaaacaatatagtctatttttcaaagagaaattgagactgatgcaaaatatttgacttcttttttttttatatgaaacataaatgtttattcattggcaaagccttaacttctctaagcctcgtttccctcatctgtcacttggcgggtaatcctatttagctcagagggttaccaggagacttaatgggatactgcataataagtactaagcacagtgccccccatcatgtactgcccttggtctgtgctctaatattgaagcaggatgcttccctgaccgctttgtgggacttgcaacaggggtgccctcaattacccagcccacagctttcaactcctcatgggaggaagcacgcatgtgaatgaggcaggaactggagtgcatgaatgctgaaaccagccagccacttaggtactgccaggagcaaacgccactcacttggacccactgtgctccaccccttgcaggggtaagcacgcgggtgagtgggtgcaggagccagggtgagcgcttttgagcgccaacaggagtgaactctgtgcaggctccgtggcagcatctaggggtggtgcctgcaacccctgaagccccagagggcatgttacagtgcttttagttctgctgtccccagacagcctaagtatcaacagctcagtggcttttcacgtaagctggctgccttctgccagtgagtacaaagggcaagtgtgacagccttttgtagccacactagcagcatccgagctcttgtcccacatccaggagaaatgacatcacacaaattgaaggatgacaaatgtaggggatttttattgccgatgaaagtggctctcagcaggaagggaagttgaaaaggggatggagagggaaggtaatcttctcctgaagtccagccatctctggccagattcttctctgatgttacgtgtcaagctgtccctctgaagtgaagctgcttctctccaatgtctaaccatagtcaccaacgtccagctgcttctcttctctctgccagctgagtatggggtttttataggcacaggatgtcagggggcaggcccatgggtggttttggaaaaggcaacatttgagctggaaaacagggatgtaagttctcactttgggctgcagtttctggcttgagggtgagggtttgacagggacccgcccctttctgcctagattttctctgccacctttctctaccattgtatcaatattattatcacatggccctgagttggaaccatcaggtcctgcaaactccagagcatctacttactgcacattggcccccccccaggggaattggtcccagccaagggtctctaggaaagaggcacatcaactagatgtggaacacactccggttttggaagtactggttctgttctccagggcatcagaatcctcctttttgtgaccctgctgcct

SEQ ID NO: 18 - DNA, 2715 bp, Homo sapiens
ttcagtttttccttatgcttttcaacttgcgcatttagttcttcttgcattttcagtcgagcagctgctaaagcttcttgtcgtttaacaacaacatcaggttctaaaatgtcagaaaaaaatggagataaagcactgtgtacaatataaaatagaaacttttgagtgtccatattattaaaagtataaagaggtatggatatcagacaatgaaacaacatatttttacataagtactcctaacccctctgcatacattttactgcttcagggggcaggggtctgttgctgagccacggattttagcccgaaatatctacatcaccagaaatctgttagaaatgccaatttctgagttcccctgagcaattccgattcataaagcctgggatagtggccacacagagcacatcttggatacctcagtgacacccacagtctctaggctgactagaatcctggaagactaccaaggaaatataaagttttctaaatcattatccatcccttaattagcgcagaagattcttaagtatttgtttctacagaaaagaaaaatccttccaaatagcattatgaatagaaatgaactcatttctattcataacgtctactcatagagtctcgctctttgcaacaaggctagactccatctcatagaaaaaaaaaaaaaaaagaaagaaaagacagtctcactctgttgcccaggctggagtgcagtggcacaatctcagctcactgcaatctccagctcccaggttcaagcgatttctcctgcctcagccaccctaatagctgggattacaggtgcccgtcaccacgccccactaatatttgtatttttagtagagacagggtttcaccatgttggccaggctgttctcgaacccctgacctcaagtcatcctcctgcctcggcttcccaaagtgctgggattacaggtgtgagccaccgcgccccaccgagaaccatatacttcctactttttttttttttttttttttaaagacaaggtctcaatcaattgcccaggctggagtgtagtgtggcccgagcatagcccactgcagctttgactccctggactcaagtgattatcccgcctcagcctcctgagcagctgggactacaggtgcgtgccgccactcccggctattttttttttttttaaatagagacagggtcttcctgtgtggcccctcttacttttactaagagactaactcttaatataaaggaggtgcaaaaccaccgctttcatttcggttatcaggcactaacccacagcagccgcagctcggtccagctgcctctgcctcaaggctcttagccgggcggaaagcttctgaaagaccacgtagagaaggatgcagctgaagacgatgtaccagccataggtggccagcagggagcccactgaaaagaaaaacagttttcaaaaaactaaaaatgacactactagttgacctttccataagactcaacaaacacaaagtgtaactcctgccctcaaagccttcatggtctaggctgaggaaaaagcctcctaagtagatcgttaaaacacgaactcaagaagtgcgacaattcagggatcactgagaagtgagacttcccaaccatctggggagtcgggggcagttagagtgtggagggcacagcaactgggttttgaagaatgaagagcaactaatctgaatcaggaaggcaaaggcctttcagagccacatagaaaggggtgacagcgcggggagtcaggagtgtgtatggggctgtgtgggacgggtcccagaggcaaacgccaacggccgagtgaccccagtaactaccacaggaagggcttggttcgcaaaaaagacttgcgcaaacaagggacagccgagccgcccagggaagtgcggctcccgagaagcctccgcgcaaggtccgggcctgctgcccaaggtccgcgtaagcgccaacgcccgaccgttcccaggcctcccaggctccggcgcccggtgcagcggcggacgacccacccatcatggctgcgcgtcgcaaaagtggcggcgcgcgcccggctgccccgcaacgactcacccgtggtgtgcaggaagcgcagcccctcggtctccagggccggccgcgcggacagagactcctcttggcgttccatgaccgccgccgccgccgccgcccagccctgccgccgcgcctccagccgggcgcttccggtgcgctcctacgcacacgtggcgcgcccggacgcggtcgtggtcccggccaatcgcaggccgaccccgccccgtcgctgggccaaacgcaggggggcgtggccgaggggcgtggcgggggagaaatcccggctacgctcgccggggccgggacagcgcgtgtgggaacgttctgtgctatctcttggcttgagtcgggggtggaggacggacctcgttcacggatttcttaccgaatttctactttcttttttttttctaattggacactgaagccaaggaagtcagtggtcgcccggaagcaggatttgcacccacatccttgcccggggcacattggacaacagggctcagttggttgacgactcccagcatttgagggttgcagccaacgtccaccccaagtgaagacacgaaatgtgagcagcctcctgctcctgctgctggtgatacctttcaggccaagaaagtccccaccgatcctcaaggttctttctc

SEQ ID NO: 19 - DNA, 3738 bp, Homo sapiens
ttcagtttttccttatgcttttcaacttgcgcatttagttcttcttgcattttcagtcgagcagctgctaaagcttcttgtcgtttaacaacaacatcaggttctaaaatgtcagaaaaaaatggagataaagcactgtgtacaatataaaatagaaacttttgagtgtccatattattaaaagtataaagaggtatggatatcagacaatgaaacaacatatttttacataagtactcctaacccctctgcatacattttactgcttcagggggcaggggtctgttgctgagccacggattttagcccgaaatatctacatcaccagaaatctgttagaaatgccaatttctgagttcccctgagcaattccgattcataaagcctgggatagtggccacacagagcacatcttggatacctcagtgacacccacagtctctaggctgactagaatcctggaagactaccaaggaaatataaagttttctaaatcattatccatcccttaattagcgcagaagattcttaagtatttgtttctacagaaaagaaaaatccttccaaatagcattatgaatagaaatgaactcatttctattcataacgtctactcatagagtctcgctctttgcaacaaggctagactccatctcatagaaaaaaaaaaaaaaaagaaagaaaagacagtctcactctgttgcccaggctggagtgcagtggcacaatctcagctcactgcaatctccagctcccaggttcaagcgatttctcctgcctcagccaccctaatagctgggattacaggtgcccgtcaccacgccccactaatatttgtatttttagtagagacagggtttcaccatgttggccaggctgttctcgaacccctgacctcaagtcatcctcctgcctcggcttcccaaagtgctgggattacaggtgtgagccaccgcgccccaccgagaaccatatacttcctactttttttttttttttttttttaaagacaaggtctcaatcaattgcccaggctggagtgtagtgtggcccgagcatagcccactgcagctttgactccctggactcaagtgattatcccgcctcagcctcctgagcagctgggactacaggtgcgtgccgccactcccggctattttttttttttttaaatagagacagggtcttcctgtgtggcccctcttacttttactaagagactaactcttaatataaaggaggtgcaaaaccaccgctttcatttcggttatcaggcactaacccacagcagccgcagctcggtccagctgcctctgcctcaaggctcttagccgggcggaaagcttctgaaagaccacgtagagaaggatgcagctgaagacgatgtaccagccataggtggccagcagggagcccactgaaaagaaaaacagttttcaaaaaactaaaaatgacactactagttgacctttccataagactcaacaaacacaaagtgtaactcctgccctcaaagccttcatggtctaggctgaggaaaaagcctcctaagtagatcgttaaaacacgaactcaagaagtgcgacaattcagggatcactgagaagtgagacttcccaaccatctggggagtcgggggcagttagagtgtggagggcacagcaactgggttttgaagaatgaagagcaactaatctgaatcaggaaggcaaaggcctttcagagccacatagaaaggggtgacagcgcggggagtcaggagtgtgtatggggctgtgtgggacgggtcccagaggcaaacgccaacggccgagtgaccccagtaactaccacaggaagggcttggttcgcaaaaaagacttgcgcaaacaagggacagccgagccgcccagggaagtgcggctcccgagaagcctccgcgcaaggtccgggcctgctgcccaaggtccgcgtaagcgccaacgcccgaccgttcccaggcctcccaggctccggcgcccggtgcagcggcggacgacccacccatcatggctgcgcgtcgcaaaagtggcggcgcgcgcccggctgccccgcaacgactcacccgtggtgtgcaggaagcgcagcccctcggtctccagggccggccgcgcggacagagactcctcttggcgttccatgaccgccgccgccgccgccgcccagccctgccgccgcgcctccagccgggcgcttccggtgcgctcctacgcacacgtggcgcgcccggacgcggtcgtggtcccggccaatcgcaggccgaccccgccccgtcgctgggccaaacgcaggggggcgtggccgaggggcgtggcgggggagaaatcccggctacgctcgccggggccgggacagcgcgtgtgggaacgttctgtgctatctcttggcttgagtcgggggtggaggacggacctcgttcacggatttcttaccgaatttctactttcttttttttttctaattggacactgaagccaaggaagtcagtggtcgcccggaagcaggatttgcacccacatccttgcccggggcacattggacaacagggctcagttggttgacgactcccagcatttgagggttgcagccaacgtccaccccaagtgaagacacgaaatgtgagcagcctcctgctcctgctgctggtgatacctttcaggccaagaaagtccccaccgatcctcaaggttctttctccaaaatcaaagccttttaggaaagaacgatcatagtaactgctctaacctgtgttgaattatactgtatcaccacaagacacgatcacagagttacttataatagtgtcctggctgtgttcctctgcctgcaacgccgtcccgcaccctcttccaccactcaaacgtcaccacctttatggtgaccataaccatcctatttgaaatgtgaccttgggtttttctggagcatttgaagtgcacatacctagctgtgtttcaaaagaagggttgggaattgggaatagaactgaaaaaataatgaataggtgacaacatccgagtgctgcgtcaccactgtcgccaggagcagtgtggggaaggcaaaccatgacatgaagcgtgaacgcaatcagtgtttcttcaatgcaggtttgccaagaagttcctcaagggggacagctgcagggatttgagcactgacctcatcaagctttcccagcagtgtgttcagaaagcaataaaggggacctggcattcatgagccatagcaaagagaagcctgaaagctcttcttccctgttggccaccttgaaaatggactcctcagatgaaccgaggactctggatgttatccataaaggctgtgaagatagcttatcgatttaatgaggaattttaggagggagaatttccttcttcatgtttgcctttccgttgtaaaaggtgatgaaccatcaccactctttgctttgctacagatgatttctcacttgctctggcatcttgcaggaacatttatgtgctaaattgaatgacttctatggaattagttgcaattctcagtcccagattagctttaaatccgccttacatctaaatactgataaactagacaggatgagcagggttgcctcaactattttgttaggctgtgaaggacattaggtataccgtactggggtcatagttcatggaaaaaaatggttagggcctcacttttctctcaggaaactcataccaaaacagtttcaatcaatgcttg

SEQ ID NO: 20 - DNA, 1268 bp, Homo sapiens
aaaatgacactactagttgacctttccataagactcaacaaacacaaagtgtaactcctgccctcaaagccttcatggtctaggctgaggaaaaagcctcctaagtagatcgttaaaacacgaactcaagaagtgcgacaattcagggatcactgagaagtgagacttcccaaccatctggggagtcgggggcagttagagtgtggagggcacagcaactgggttttgaagaatgaagagcaactaatctgaatcaggaaggcaaaggcctttcagagccacatagaaaggggtgacagcgcggggagtcaggagtgtgtatggggctgtgtgggacgggtcccagaggcaaacgccaacggccgagtgaccccagtaactaccacaggaagggcttggttcgcaaaaaagacttgcgcaaacaagggacagccgagccgcccagggaagtgcggctcccgagaagcctccgcgcaaggtccgggcctgctgcccaaggtccgcgtaagcgccaacgcccgaccgttcccaggcctcccaggctccggcgcccggtgcagcggcggacgacccacccatcatggctgcgcgtcgcaaaagtggcggcgcgcgcccggctgccccgcaacgactcacccgtggtgtgcaggaagcgcagcccctcggtctccagggccggccgcgcggacagagactcctcttggcgttccatgaccgccgccgccgccgccgcccagccctgccgccgcgcctccagccgggcgcttccggtgcgctcctacgcacacgtggcgcgcccggacgcggtcgtggtcccggccaatcgcaggccgaccccgccccgtcgctgggccaaacgcaggggggcgtggccgaggggcgtggcgggggagaaatcccggctacgctcgccggggccgggacagcgcgtgtgggaacgttctgtgctatctcttggcttgagtcgggggtggaggacggacctcgttcacggatttcttaccgaatttctactttcttttttttttctaattggacactgaagccaaggaagtcagtggtcgcccggaagcaggatttgcacccacatccttgcccggggcacattggacaacagggctcagttggttgacgactcccagcatttgagggttgcagccaacgtccaccccaagtgaagacacgaaatgtgagcagcctcctgctcctgctgctggtgatacctttcaggccaagaaagtccccaccgatcctcaaggttctttctc

SEQ ID NO: 21 - DNA, 7076 bp, Homo sapiens
ggttgatagtagtggggcagatggtatgatctaagaatgacacacagtgtcaaagggagagagggaaggttggacagtggtggtgggaggagggaatgatatcttccaaaaattacccacaagggcaagaagggagaaagggataatggagaaagatgggtggtgttttaggaaagacccacagaaacaaggcgagatggggactggaagggtggatggcattgggggattttgtcttctaggaatgagccacagggattagggggagataggaaggactgatggggcaggaagatagtatgttccaggtatgatccacaggttcagaggggagaaaagtatagtggatggtgtttgccatggatgaaccaccaggatagtgggggagacagaaaaggttgatggtgtggtgggatggtatcttttatgaatgacccaaaggggcaaagggaaggcaggaaagatggatgttgcggggatatcatccaccaacaacccagaggtgtagtggggagacaggaggtgtagatggtattaccaggatatgtcttccagaaatgagccacaaaggcagggataagataggaagagtgaatggtgtggcctggttgcatcttccaggaatgcccccacagtgttagggagtggggaacaagaatggatccctgtgggggtatggtatcttctaggaatagcccacagagtcaaggggaaacaggcaacattaggtagtgtgtgtgtgtggtggggaaatggggcgggggtggggtggggagaatgaaattttccagctatttctctctctctggggagagaaagggaaggttggtttgtgtggatggagatggtatcttctaggaattacccaaaccagaagggtggatgtcttaggggaaggggaattttccagcaatgacccagagggatggtggggagacaggaaacatagatggtgaggcaagatgatgtattccagaaatgacccacagggcaaggggtagatacaaaggtggatggggtgagggagatggtctcttccagttatgacccacaagggtagaggggacacagatggtgtagatcatttggcaaaatggaattttccaggaatggtccacagggaagagggtacataggaaggtttggtggtgtggcaggatggtatcttccaggaatgagctacactggcagtggtaggggggagaaaggaagggtggatggtgaggggtcatggtttcttccaagaatgactcataggattgtacaggaatgacccagaggggtagcgcagagagaggaaacatgactggtgtggcaggatataccttccaggaatggtctacaggagctaggggatgcagggaagatgggcttgtttgcaggcatggttcttcctggagtaacccaaagggtcaggggtgagacagcaagggtggatattgggccgcggataacttccagcaatgaccaaaagagatgggaggagacaggaagtgtggaaggtgaccaggatggtatttccaggaatgaccctcaagagttgggagagacaagtaggatagatgatttgatggagtggtatcttccaggaatgaaccaaaggggcagaagaaaacatggtacattgtgtttagagagatggaatcttccaggaatgagttaccctggtggtgttttcggggacatggaaagggtggggatagtatcttccaggatgacccacaaggccaaggggggagacaggacagggtggatactgtgtttgtagggggagggcatgttacttctcagggatgtgacacaggcactgtggggacacagagaagggtagatgttttgtggaggaggtggtctcatcccgaaatgacccagagggtttagaaaggtgtagcaggatggtatcttccaggaatgagccacacggttggtggcgggggaagatgggtggtatagagagatggtatcttccaggaatgacccacaggggcaagggggtgacctgaagggtaaaggttgtgaagggggatatcttccagtaatcacccaaaggggtagggggagataggaagaaaagatagtgaggcaggatgatattttctaagaatggtcttcagaatgtgtggggttaagtaaacaggaaaggtggatggtgtaggaagatcgtatcttccaggaatgagccaccgaggttggggtgagacaggtaggtggatggttttgtagaatggtattttccaggaatgagccacagggcagggggtagatataaaggatggatggtatgggggagatggtatcttccaggaatgaactacaaaattgaggaaggaggggaatgatggatgagctaggtggatgggatctgccaggatggcccacagagccaaaagaaagacaaggcagagtggataatgtaggggaaatagtatcttccaggaatatcacacaggcaatgcagggaggcaggaaagggtagatgttttggtgagggagtggtatcatccccaaatgacccagagtggtagaggggagataggatagttgaatgacaggatagtatcttccaggaatgagccacggtgacagtggtgggggtgggagacagtaagagtgtatgtggatggtatcttccacgaatgacccacagaagtcagggaaataagtttaggcaaatggtatctcctaggaatgtgccaaaagggtagtggtggggggagatgggaatggtggatattgtggaagtgatatcatacaggaatgagccagagggggtagtgaggagtcaggaatcatgaatggtgtggcaggatatattttcaaggaatgacccacatgggctaaggggacacagggaatgttggcctgactggggacatggtatcttcctggagtgactcaaagggttgggggaagataagaagggtggatgttgtggggaatacattccaacaatgacacagaaggatggggcgagacacaaagtggttaaggtgaggcaggatggtattttccaggtatgacccacaaggttgggagagtaagaaagatgagtgatggtggggggaaatggtatcttccaggataaccctcaggggtaagggtaaacaggacaaggtggatagtgttgaaggggttatatctttcaggaatgtgactaagtctctggggggaaacagggaagggtagatgttttgtgagggagtgataccaaaatgacccagaggaatagtagggaaataggacagttgcatggcatgtcaggatggtatcttccagaaatgagtcacactggtggtggcggaaagagacaagaaaggtggatgttatcattcaagatgatatcattcaagaattacccagaggaataggggagagacaggaagcctgactggtgtggcagggtatattttctgggaatgagccacaggtgtgggagaagacagtcagggtagatggtttggtggaatgaaatcttccaggaatgacccacagggtcatgggggaaaattgaagggtagacattgtggatggagatatcttccagcaatgacccagagggatgggggagacaggaaatgataatggtgcagcaggatggtatcctccaggattgagccacactggtggggttgtgggggtcatggtatcttccatgaatgacccactggggtcgagggaagactggtagggtagatggtttggcggaatgttattttacaggaatgacccacagggcagaaggtagataggaaggatggatacagtagaagagatggtatgttccagtaatgagctatagaatttggggagggggggaatgatggatgaggtagggagatggtatcttccaggatgacccacagagccaagggggagacaaggcagactgtataatataaggggtatagtatctttcaggagtgtgaaccaagcactgcaaggaggcagggaagggtagatgttttaggaagaaggtggtatcatcccaagataaccaagaggataacaggaaaatagaatggttagatggtgtggcaggatggtatcttccagaaatgagccaaatgacagtggtgggggtggcagaaggtatgggtggatggtatcttccaagaatgattcacagaggcagggggtggcagaaggtatgggtggatggtatcttccaagaatgattcacagaggcagggggagacagggtacattgggtttagagagatggtgtcttccaggaatgagacacctgggtagtagtgggggagacagggtacattgggtttagagagatggtgtcttccagtaatgagacacctgggtagtagtgggggaaaacaggaagggttgaagtgtggggggatgatatcatcctggaatgagccagaggattagtgttgggggggttatatcaggaatgtgacaaaggctctgcggggaaacagggaagcctagatgttttagggacggtgtggtatcaccccgaaatgatcagaggggtagtggggagatacaacggttgcatggcgtggcaggatggtatcttccaggaatgagtcacactatgggtggtgggggagaccatcagggggatgttggctggcatggtatcgttgtggaatgacccagagggacagggcagagagagaaagcatgaatggtgtggcaggatatattttccaggaatgagtcacaggggcagtagggaaacatgaagagtagatggtgaggtgggatggtaccgcccaggaatggtccacaggagctaggggatgcagagaacattggcttgttggcaggcatggtttttcctgtagtgacccaaagggttgggagtggtgggggagataacttccatccacgacccagaggagagggagtagacaggaagtgtggaagatgaccacgatggtatcttccagggatgacccaaaggggcagagggacacagggtggattgtgttttgagagatggtgtcttctaggaatgagccaccctggtggtgcctggggggacacaggaagaggtatgtggagatggcatcttcctggatgacccaaaggggaaagggggagacaaggcaaggtggaagtgttgggggaggtgtgacagtatctttcaggaatgtggtatagtcactgtggggaaacagggaaggctagatgtggttatatcatctcgaaatgacccagaggggtagagggaaataggaaggttgcatggtgtggcaagatggtatcttccaggaatgaggcacactggcagtagtgggggtggagacaggatggaaggtggatgtggatggtattttcctggtgtgacccgcaggggcagtaggtaacagtggattgggtttagagagatggtgtcttccagcaatctgccacaagggtggttagaggtccgggggataccggaagggtggatggtgtagcaggatggtatcttccaggaataaaccctggcaggtgggtgttttgggggaattgtgtcttccaggaatggaccataggggtagatgggagacaggtagggtatgacagaatgatattttccaggcatgacccacagggcaggggatagagaagaaggatgaatgttgcattggagatggtatcttccaggaatgaactacggaattggggaagcgggggaatgatggatgacgtaggggaatgggatcttccaggatggctcagagatcccagagggagtcaaggcagggtaaataatgtaagaggggatagtatctttcaggaatatgacacaggcactatagggtagacgttttggggaggaggcggtatcatcctgaaatgacccggaggggtagtggggaaacaggaaggttggattgtgtggcaggatggtatcttccaggaatgaaccacactggtggtgcttcgagggggacacaggaccggggatgttatctaacaaaatgactgacagggaagagtagatagttctgtgtaggggtatagtatctttcaggaacgtgacacaggcactgcggggagacagggaagggtagatgtcttagggagtgggtggtatcatccagatatgactcaggagtaggggggaaatagaaaggttggatggtgtggcaatatggtatcttccaggaatgaaccacacaggtggtgactgggggaggcaggaaaggtgggtggtgttaggggatggtgtcttctaggaatgacctacaggagaagggggagacagggtggattggctttggagagggccacaggtgcggtggctggggagacaagaagggcagatggtgtggaaggatggtatcttccagaaacaacccacagggatacagggagacaggggtttagagagatggtatcttccaggaatgagccacatgggaagtggtagggagagacaggaaggatggacgttgtggggggtggtattcgggaatgacatagctgggaatgggggaaacaggaaacaggaatgctgtagcaagatacatcttccaggaatgagccacgagggcttgaggggagacattatgattggatagtgttggtacatggtatattcaaggaattagccataggtttagaggggagacagcaagagtagatggtgtagagaggatgatatctgcctctaatggcccacaggtgcacgggggagataggggagattagatagtgttgggggaattatatcttccgggaatgtgacacaggctctggaagagatggtgaaggtggaatttggttgtggggtgggggaggggggaggtaatgatatccccaaatcacccatagtattagggtggcaataggaagattggatggtgtaggcagatggtatctactaggaatgactttcagagtcagtggggacatgtgaagatagaaaatgtgtttgcagagatactgtcttctaggaatgagacacacttgctgaggggaggcagggaagggtgtatgttttgggggcaatggtgccatccagaaatgaaccagaggagtaggggatagacaggaagagtcaatggtatgtggcaggatgctaccttccagaaatgacccacaggtatgtggggaga

SEQ ID NO: 22 - DNA, 8133 bp, Homo sapiens
aagaaaagtgggtgaatgaagtagaacttcttttaatgaaagcattgtgtgatctgcaataaaatcaataattgtgttttcatattattgaaaggttgcctacaaaagcagtttgaaaagatattttttaaaaatgtggtacatttacaccatggaatactatgcagccataaaaaagaatgaaatcatgtccttttcagggacatggatgaagctggaagccatcattctcagcaaactaacacaggaacagaaaaccaaacatcgcatgttctcactcataagtgggaattgaacattaagaagacatggatgcagggaggggaacaacacacactggagcctgtcaggtggtgggaggagggagagcatcacgatagataactaatgcatgtgggtcttaatacctaggtgatgggttgatgggtgcagcaaaccactatggcacatgtttacctatctaataaacctgcacatgtactccggaatttaaaataaaataaaatggtaatcccatatagatgtggaatactaggaaatgagaggaaagctagtctgtagtaataaaaatgttcaattagaccatgtcttattagtttatgtggggcttactatgtgaaggcaccataccaggcactgaggaatgggggtgaacttcttaggaatagcccctaccctcatggagtttatgtttttctagcaggcaagactgaccttgagcacaattacataatgctaggagagttcctgtaacagggagaaccttacatggtctgagggtacaggaagcattctttgatgaagcaatctttaacctgaaactaaggagttagtgcatcaactaagaatgagccatcggggcaggggggagtcagaaaaggtgaacagtgtagggcgatggtatcttccaggaatgatacacagggacaggagagagaaaggaagaatggatgaagttggggggatagtatctgccaggaataagtcatggggcaggagaaagacaggaagggtggatggtgtggtagaaatcgtaccttccaggagtaacccatagggttgatagtagtggggcagatggtatgatctaagaatgacacacagtgtcaaagggagagagggaaggttggacagtggtggtgggaggagggaatgatatcttccaaaaattacccacaagggcaagaagggagaaagggataatggagaaagatgggtggtgttttaggaaagacccacagaaacaaggcgagatggggactggaagggtggatggcattgggggattttgtcttctaggaatgagccacagggattagggggagataggaaggactgatggggcaggaagatagtatgttccaggtatgatccacaggttcagaggggagaaaagtatagtggatggtgtttgccatggatgaaccaccaggatagtgggggagacagaaaaggttgatggtgtggtgggatggtatcttttatgaatgacccaaaggggcaaagggaaggcaggaaagatggatgttgcggggatatcatccaccaacaacccagaggtgtagtggggagacaggaggtgtagatggtattaccaggatatgtcttccagaaatgagccacaaaggcagggataagataggaagagtgaatggtgtggcctggttgcatcttccaggaatgcccccacagtgttagggagtggggaacaagaatggatccctgtgggggtatggtatcttctaggaatagcccacagagtcaaggggaaacaggcaacattaggtagtgtgtgtgtgtggtggggaaatggggcgggggtggggtggggagaatgaaattttccagctatttctctctctctggggagagaaagggaaggttggtttgtgtggatggagatggtatcttctaggaattacccaaaccagaagggtggatgtcttaggggaaggggaattttccagcaatgacccagagggatggtggggagacaggaaacatagatggtgaggcaagatgatgtattccagaaatgacccacagggcaaggggtagatacaaaggtggatggggtgagggagatggtctcttccagttatgacccacaagggtagaggggacacagatggtgtagatcatttggcaaaatggaattttccaggaatggtccacagggaagagggtacataggaaggtttggtggtgtggcaggatggtatcttccaggaatgagctacactggcagtggtaggggggagaaaggaagggtggatggtgaggggtcatggtttcttccaagaatgactcataggattgtacaggaatgacccagaggggtagcgcagagagaggaaacatgactggtgtggcaggatataccttccaggaatggtctacaggagctaggggatgcagggaagatgggcttgtttgcaggcatggttcttcctggagtaacccaaagggtcaggggtgagacagcaagggtggatattgggccgcggataacttccagcaatgaccaaaagagatgggaggagacaggaagtgtggaaggtgaccaggatggtatttccaggaatgaccctcaagagttgggagagacaagtaggatagatgatttgatggagtggtatcttccaggaatgaaccaaaggggcagaagaaaacatggtacattgtgtttagagagatggaatcttccaggaatgagttaccctggtggtgttttcggggacatggaaagggtggggatagtatcttccaggatgacccacaaggccaaggggggagacaggacagggtggatactgtgtttgtagggggagggcatgttacttctcagggatgtgacacaggcactgtggggacacagagaagggtagatgttttgtggaggaggtggtctcatcccgaaatgacccagagggtttagaaaggtgtagcaggatggtatcttccaggaatgagccacacggttggtggcgggggaagatgggtggtatagagagatggtatcttccaggaatgacccacaggggcaagggggtgacctgaagggtaaaggttgtgaagggggatatcttccagtaatcacccaaaggggtagggggagataggaagaaaagatagtgaggcaggatgatattttctaagaatggtcttcagaatgtgtggggttaagtaaacaggaaaggtggatggtgtaggaagatcgtatcttccaggaatgagccaccgaggttggggtgagacaggtaggtggatggttttgtagaatggtattttccaggaatgagccacagggcagggggtagatataaaggatggatggtatgggggagatggtatcttccaggaatgaactacaaaattgaggaaggaggggaatgatggatgagctaggtggatgggatctgccaggatggcccacagagccaaaagaaagacaaggcagagtggataatgtaggggaaatagtatcttccaggaatatcacacaggcaatgcagggaggcaggaaagggtagatgttttggtgagggagtggtatcatccccaaatgacccagagtggtagaggggagataggatagttgaatgacaggatagtatcttccaggaatgagccacggtgacagtggtgggggtgggagacagtaagagtgtatgtggatggtatcttccacgaatgacccacagaagtcagggaaataagtttaggcaaatggtatctcctaggaatgtgccaaaagggtagtggtggggggagatgggaatggtggatattgtggaagtgatatcatacaggaatgagccagagggggtagtgaggagtcaggaatcatgaatggtgtggcaggatatattttcaaggaatgacccacatgggctaaggggacacagggaatgttggcctgactggggacatggtatcttcctggagtgactcaaagggttgggggaagataagaagggtggatgttgtggggaatacattccaacaatgacacagaaggatggggcgagacacaaagtggttaaggtgaggcaggatggtattttccaggtatgacccacaaggttgggagagtaagaaagatgagtgatggtggggggaaatggtatcttccaggataaccctcaggggtaagggtaaacaggacaaggtggatagtgttgaaggggttatatctttcaggaatgtgactaagtctctggggggaaacagggaagggtagatgttttgtgagggagtgataccaaaatgacccagaggaatagtagggaaataggacagttgcatggcatgtcaggatggtatcttccagaaatgagtcacactggtggtggcggaaagagacaagaaaggtggatgttatcattcaagatgatatcattcaagaattacccagaggaataggggagagacaggaagcctgactggtgtggcagggtatattttctgggaatgagccacaggtgtgggagaagacagtcagggtagatggtttggtggaatgaaatcttccaggaatgacccacagggtcatgggggaaaattgaagggtagacattgtggatggagatatcttccagcaatgacccagagggatgggggagacaggaaatgataatggtgcagcaggatggtatcctccaggattgagccacactggtggggttgtgggggtcatggtatcttccatgaatgacccactggggtcgagggaagactggtagggtagatggtttggcggaatgttattttacaggaatgacccacagggcagaaggtagataggaaggatggatacagtagaagagatggtatgttccagtaatgagctatagaatttggggagggggggaatgatggatgaggtagggagatggtatcttccaggatgacccacagagccaagggggagacaaggcagactgtataatataaggggtatagtatctttcaggagtgtgaaccaagcactgcaaggaggcagggaagggtagatgttttaggaagaaggtggtatcatcccaagataaccaagaggataacaggaaaatagaatggttagatggtgtggcaggatggtatcttccagaaatgagccaaatgacagtggtgggggtggcagaaggtatgggtggatggtatcttccaagaatgattcacagaggcagggggtggcagaaggtatgggtggatggtatcttccaagaatgattcacagaggcagggggagacagggtacattgggtttagagagatggtgtcttccaggaatgagacacctgggtagtagtgggggagacagggtacattgggtttagagagatggtgtcttccagtaatgagacacctgggtagtagtgggggaaaacaggaagggttgaagtgtggggggatgatatcatcctggaatgagccagaggattagtgttgggggggttatatcaggaatgtgacaaaggctctgcggggaaacagggaagcctagatgttttagggacggtgtggtatcaccccgaaatgatcagaggggtagtggggagatacaacggttgcatggcgtggcaggatggtatcttccaggaatgagtcacactatgggtggtgggggagaccatcagggggatgttggctggcatggtatcgttgtggaatgacccagagggacagggcagagagagaaagcatgaatggtgtggcaggatatattttccaggaatgagtcacaggggcagtagggaaacatgaagagtagatggtgaggtgggatggtaccgcccaggaatggtccacaggagctaggggatgcagagaacattggcttgttggcaggcatggtttttcctgtagtgacccaaagggttgggagtggtgggggagataacttccatccacgacccagaggagagggagtagacaggaagtgtggaagatgaccacgatggtatcttccagggatgacccaaaggggcagagggacacagggtggattgtgttttgagagatggtgtcttctaggaatgagccaccctggtggtgcctggggggacacaggaagaggtatgtggagatggcatcttcctggatgacccaaaggggaaagggggagacaaggcaaggtggaagtgttgggggaggtgtgacagtatctttcaggaatgtggtatagtcactgtggggaaacagggaaggctagatgtggttatatcatctcgaaatgacccagaggggtagagggaaataggaaggttgcatggtgtggcaagatggtatcttccaggaatgaggcacactggcagtagtgggggtggagacaggatggaaggtggatgtggatggtattttcctggtgtgacccgcaggggcagtaggtaacagtggattgggtttagagagatggtgtcttccagcaatctgccacaagggtggttagaggtccgggggataccggaagggtggatggtgtagcaggatggtatcttccaggaataaaccctggcaggtgggtgttttgggggaattgtgtcttccaggaatggaccataggggtagatgggagacaggtagggtatgacagaatgatattttccaggcatgacccacagggcaggggatagagaagaaggatgaatgttgcattggagatggtatcttccaggaatgaactacggaattggggaagcgggggaatgatggatgacgtaggggaatgggatcttccaggatggctcagagatcccagagggagtcaaggcagggtaaataatgtaagaggggatagtatctttcaggaatatgacacaggcactatagggtagacgttttggggaggaggcggtatcatcctgaaatgacccggaggggtagtggggaaacaggaaggttggattgtgtggcaggatggtatcttccaggaatgaaccacactggtggtgcttcgagggggacacaggaccggggatgttatctaacaaaatgactgacagggaagagtagatagttctgtgtaggggtatagtatctttcaggaacgtgacacaggcactgcggggagacagggaagggtagatgtcttagggagtgggtggtatcatccagatatgactcaggagtaggggggaaatagaaaggttggatggtgtggcaatatggtatcttccaggaatgaaccacacaggtggtgactgggggaggcaggaaaggtgggtggtgttaggggatggtgtcttctaggaatgacctacaggagaagggggagacagggtggattggctttggagagggccacaggtgcggtggctggggagacaagaagggcagatggtgtggaaggatggtatcttccagaaacaacccacagggatacagggagacaggggtttagagagatggtatcttccaggaatgagccacatgggaagtggtagggagagacaggaaggatggacgttgtggggggtggtattcgggaatgacatagctgggaatgggggaaacaggaaacaggaatgctgtagcaagatacatcttccaggaatgagccacgagggcttgaggggagacattatgattggatagtgttggtacatggtatattcaaggaattagccataggtttagaggggagacagcaagagtagatggtgtagagaggatgatatctgcctctaatggcccacaggtgcacgggggagataggggagattagatagtgttgggggaattatatcttccgggaatgtgacacaggctctggaagagatggtgaaggtggaatttggttgtggggtgggggaggggggaggtaatgatatccccaaatcacccatagtattagggtggcaataggaagattggatggtgtaggcagatggtatctactaggaatgactttcagagtcagtggggacatgtgaagatagaaaatgtgtttgcagagatactgtcttctaggaatgagacacacttgctgaggggaggcagggaagggtgtatgttttgggggcaatggtgccatccagaaatgaaccagaggagtaggggatagacaggaagagtcaatggtatgtggcaggatgctaccttccagaaatgacccacaggtatgtggggaga

SEQ ID NO: 23 - DNA, 204084 bp, Homo sapiens
aaagaaaggaagagtattcctacttacaccaatggaatgaagatgtatcttggactgtgtaaaaagaaacagcaatagcttacatttttagcatgcctttcttctgagaaagcattagctcttcacttaatagtacacttgtttttctcatcacttctgtaaagtaggatgagcaaggaaagggtaaaggagcaggatcattttacaaacagaaactaacacacaaataatgtgttacttgttaattgccatagaagcaatgtttttcgctaaacaaaaccctccttaacgtcaaatctagtattttaaaaaatatttatccaagaaggagattttaaaaaatatatacatgtgtctgctcatcggtgcaaaaaaatacaggaaagataagccaaaacgtactgaaattgctaacctacaggacgttgagtgagaaaaggatataaagaagaatgtatagcttttttagaaccacagtaatgtttcccatacaaaaataaaaattaacaatgcggggtggggaaaacagggaaggctagaattgaatactgtagtaacaaatgaacctaactgtattacaaaacaacataaccatactgaaagatttggtggaaggaaataactaacctacgtaacttcagaaaactgtattttgactgcataacagttaacatactgtacaaaaatattgtactctagttagcaaatgtgtttttcacaggggtactagatgacaactgtgagactatacgggtactaggattaaacgagtatcaataaggaagggggaaggctgctgtgttgaactggtatgaacttacggttttttatatatatatacaggttaagtagatacagaaatatagatgtgtgtgtatgcacctgtgagcatagatacatatgtttccttgctttgccttttgagacatcctagaagcagtgacacttacgaagtaacaatgagcacaactagtactcagattttagttcctaataaaaggaacctgagctgaagtaggcaaaatacaagaggaacctggaacatctagtattagaaagtatttcaaaatataagcggtacatgctaaaaggacacaggagccaatctgaaagagcgcccaatacccaaagttgagataactggagcaactgtataaacagtaataggttataatccattaaataaaataaatatccatgggaccatcctgatattcacaactgagtcaatgaatgagtaaataaatgaggggggaagacacctcttcctaacagaattccatttaatgcaggtaggaagtagaacaaccaccctttagtaaacaacacagcaataattgctgtaggaaaaagtcatcagtgaacaataaaattatgagtaaaaatataatgagcaacagaatatttacatagtgtctccctataagacagtcatttattccagccagggcaaaatggcaaaaccttgtcactacaaaaaacataaaaatgtgccaggcatggtggcacatgcctgtgatcccagctacttgggaggctgagagatgggaggatagctgagccagggaggtgaaggctggagtggtgattgcgacactgcactccagcctgggtgacaaagtgagaccctatctctaaataaataaataaataaataaataaataaataaataaatattgtcagttattacaaagggaaaaatgctaattttacagaggagaaagctgtcaggcaccaccttaaccaagggaacaaacctatcatcactattagaaagacaagtcaaaatcatgaaccccctgtggtgtagagaagggtacagtatcttctgtggcattcctgtaaaacaatgcgtaacctctaataatgagaaaacaccaatttgtggaacgctatacaaaataactgaccagaaatcttgtatccaagtaatgaaatacaaaaactgagaactctcacatattgaaggacatttagagatgcaaaaactaaaagcaatgatagattctggacaacagaaaggacattaataagaaaactaataatacagaaattcaaataaagtatgtctattactttgtataagttcaatgttaatttcaatgttaatttcgtggttctgataattaacgattattgtgacaagatgtgttaagattagagaaagctccgtacggagactctgtactactatttcaacacacacacactctctctttctttctgacacaatctcgctgttgaccaggctggaatgcagtggcacaatcttggctcattgcaacctctgcctcctgggttcaagtgattcttgtgcctcagcctcccgagtagctgggattacaggcgcacaccaccacacctggctaatttttgtatttttagtagagacggggtttcaccatgttggccaggctggtctcaaatttctgtcctcaggtgatctgcccacctctgcctcccaaagtgctgggattttaggtcaccgtgcccagcctaaaatcatattttaaaagaatgaagaaaaaatgtatctagcattaataaaacaaacttcattcatacataaatctgtacagtctacaggttcctatcagttacagtactcacttaagataaatatagaatccattctgaattggccaaaatatccaacactccatcacagaaaagtatttgcagttacctgataatgccaggctctttcaagcctatgctgcattacacattactccctacaccatgcttcagcaagtccataagactcagaaaaaagtccatccttccctaggaaactacctttactgactccctccagcactcccattttatgcttgttggaagaacaagaagcactcaagaaaagatagatacctggttctacttagtctttcagacacaaagtgcagtctggaacaatgacaattagcttttactaactttcattatctatcaaacattgttaaaagcaaattataaattttaaattaactttgtaagaaggctagaaatcaggtagtaggaggagagtgtgactcctccaatttggttcttgtttttaaaaattgttttggctactggccaggtgcagtggctcacgcctgtaatcccagcactttgggaggccgaggcaggcggatcacttgaggtcaggagttcaagactagcctggccaacatggtgaaacccccgtctccactaaaaatacaaaaactagctgggtgtggtggcacacgcctgtaatcccagctactcgggaggctgaggcagaagaatcacttgaacccaggaggtggaggttgcagtgagcccagatcacaccacagaactccagcccgagtgacagggagagacttcatctcaaaaaaaaaaaaaaaaaaaattgttttggctcttgaaaatacttaacatttccatacatacttgaaaatcaatgttcaattgttaccaaaaacaacacaacataaaccaaaaaatcttgctgggatttttcactgggtttgcattgaatcattgtgtctaacattgactcttctaacacataaatacagcatacatctccgttcacttatgtaatctttttcagaagttttatggtttcagcaataaagtcattaacgtcttttgttagatttattcctaagtattttatgtttcttgatactaccgcaaatggaactgtttctccgggttatttttcagttgtttgctctaataaataaaaatagaattgacttttatatattgaccccgtacctggagaccttggctaaatctctaattctcacaggtttagggaattccatggggtttctaagtatcatatcttcaaatacaagcagttttgccctaccttttccaatttccatgcctttaattgcttttttcttgcaatattgcattagccaagacagagtacaatgtttttgtttgtttgaggcagggtctcaccccgtcgcccaggctcaagtacagtagcatgatctcagctcagtgcaacctccaccacctgggctcaagcaattctcccacctcagcttccagagtagtgaggactacaggtgcacgcccccacaccaggctcatttttgtatttttttgtagagatggggtttcgtcaggttgctggagctggtcttgaactctgaggctcaagcgacccgcccaccttggcctcccagagtgctgggattacaggcatgagccactgtgcccagcttacaatatttttaggatatatttttttcctaattgtagaccaacaaaacaagcactttcaccaagtagtgtgatgttaggcgttaggtttttttcctaatttttaaacagcatcacagctcaggaataaggtcttcacctttgattttcacgatttttactacaatgttgtgattctcatggttattattcttgaagtttcatgatttttttattttatttttgagacggagtctcactctgttgcccaggctgcagtgcagtgccatgatctcggctcactgcaacctctgtctcctgagttcaagcgattctcctgcttcagcctcccgagtagctgggattacaggtgtctgccaccacgcttggataatttttgtatttttagtagagatagggtttcaccatgttggccagactggtctcaaacttctgacctcaggtgatccacccacctcggcctcccaaagtactgggattacaggcatgagccaccgtgctcggcctaaagtttcatacatttgtaaactgactgtttaaattcaaaaatccagtcattaagttcctcaatttttttccatctttttttttctttttcctcatgactaagaatcatattctcatgtttattcatatgtatggtaattttctattatatacagacaatgtatgcaatacattatagagactctgaatttagttagcttttcctaaagagtgttgatttttgttctagcaggcatactactactacctggttaccttcattttgtggagctagttttgtttttataaaagcatagtggagtctattttggttccctccttaatcctatggtgaatgccttcgtcctgggaaacattctttaactctttaagtgtgagcctttattggtttcaatcaaagccctcaggtttttgccaagtctagttggaattcgaactccaaattctgccttccctgcattaggcaatgatgatcttctctgctcagctctttcagccttccaattactgctttccactatgccctataaaatcttccctaaacatgtgcaggtcaggggtgagcacaaagatctgaaaggggctcaaatagattgtgggcctatgcccctccccatctcccatagctccctctttgccactattcccctccttcaatttctacctaacttggcagccctgaactccatcctctgataatatacaaacaagcccatgaagcagtgactattgaattctagaagctctggggcacatggactgagaatgctctcatctcttcctggcaatactttctgtctgaaattttgctgacattgttgagtaatttacctagtaatatgcacaggttccaagcttgcccttctttgctcattactttttcttaagcaggggaaagcaagcttctatttgaagagagagaatgagaaggtggggaagataagaggcatgtttcaatacactagagaacaactctcaaccgctttttacatgctctctttccaagggcacaccctctttgttcaaaaggagtcttaaatttcacagaagcatttatctgtacacacgacttatcggcagctaccaagctagaggcccgttaagttttctctccctcagctagccttacacctttaaaactgcctttgagtcagaagtcagaatgaagaggttaaaataaaaaaagaggcatttttctaggcattcctccttaggtcttccctttctctaacccactactctgtggtataaaaacagtacccacttccctaacccagaaaatattccttgatttgctccatgactcaaaaaaggttcacccatgaattcagtctccagttcttttgctcataggttgggtccttttagaacaacttagttcaataatatctgtactgtattcaagacccaagcagatatatactggttctgtcaataaacaatcatcctgtttggaaataaagcaaaaagactatgtatccttgcagtgtaccactgggacattacctaacaagcccacccaggaaacatctgactctccataaattatttaactttgttttacctactatctataattgattagggcccagaagtcttactggatgtttattttagaacgctgacaagttaaagttggtttgcatcttgttgaaaacaatgtccaaagttacagctttattgttctataggatattaataacttttgtatgctactgagtaatcatattcctgcattcttcctttttatctggtattaaaatactgttaacagtttggccaccatcatgattcccttgttattcagtaaatcactatatatttaggaattatgtctaggctggtgcagtggttcacacctgtaatcccagcagttttggaggccaaggccagcggattgcttgtgctgaggagtttgagaccagcctgggcaacttggtaaaaccccatctctacaaacaatacaaaaattagccagacatggtggcacatgcctgtagtcccagctacttgggaagctgaggtgggaggatcacttgaacctgagaggtagaggctgcagtgagccaaggtcgcaccactgcactccagcctgggtgacagaataagaccctgtctaaaaagatggaaagaaagagagaaaaagaagagagaggggagagagagacagagagagagagaaagaaaaagaaaagaattatatctaatgttttgaaactatattttgacaattctaaagacgctgatttttttgttaattccagctgagtttcagaaatgagaataaaaaaattaaacataacagaaaatacctctgacattattatttttaaactacaagtcttcaaatatatttttgggtaataaacaagcacagtccaggagtttgaggctgaagtgagctatgattgtgcgattacactccagcctgggtgacagagcaagagcctgtcttaaaaaaaaaaaaaaaaaaaaaaaaggaataaatacacctacctccatttggggaaaaaattaacaaaatggaaaacaggctggttacatgtgggtatgaaaacctacagttgccctctgtcccgggcaacctaatttttttttttaagcaaaactgagaaaagtcactttcctaaaatttaaaacaaaacaaaacaaaaaaacctggggaacaaacaagcaaagttaaatactgccttcttatacagaaaaactttgcctggcaattgacatacgcacagctttgcaaatatttggcattttaaaaatttaagtcaatagcttttaagaaacatatgctctgcgcccattctactaataataaacaatggaaatgtattgtccctgctccccccaccccaccccccaacccctgtcttctcttaatactttctgaacgcttttcagaaagcatggatatattcataaagggtagataattcacgaaaacagggaaggggtaatctctccttgacaaaatagtgacagtgtatacttagttgttttcattatttattttactcaatccaaaaagcattctattgcacaatgttgaaactagtatggccaacacaaagggaaagatggtcttgaccttcaagaatcttacaatttaatacacacacaggaatcttacaatttaacacacaagtaaatgaatgaagggtagggaaaggaccaagctcctaaagagtgtgtgtgtacaagtgaatctgtataaactgtctcacaatcactgtggattttttaagacaatgaggattagtaacacaatggaggactgttatgccctgtccttcagaagtgctgaggtaagagaaaacatgactacagggagattactcaaaaaagtttggaatccctaaattctatatacaaatatataagtatctacatagaacttactcccctatcacatatgcctcatgtttcatgtttcctgtacccataccaccaatgtatctatgtttcctttctcacttaacaatttttaccctgattagaccattcactaaaagtttcattaataacttaaaaaagatctgtaaacagcatgcaatgaacttatattatagacttaaatagtggcaaaacttggcattctgctctttaatttattcaaaactactttccagttaagaactatcaatcttctagtgtcttcacatttatctctagcaacagtggctggctttcaaaattaggtgagagatctttccaagatctaaacatctccaatatctgcctcagagaaaatttagtttccaccacatcatgcgttcctgctaacaatgattaaaataaataaaagaactataaggttggtttatttgcggatacaagaacagcttgcttaactcaccatttaaaaagccatcacttcacactagctttattatctgaagcataatcaaaataataaactacggttgtgggactttggaatttctaattaagttatggagacttaaatcaagaaatatgaatattcataaaacccagtaaccttttaggcaaagtaaaaaagtgaaaagaacaagtgctcttggaattcagaaagaaaattaactatggtattgagagaaaccaggaaagagaaggaatcacagtagagctaggatacagaaggaaacagaaaatgacagtttaatgctcattatagaataacagtgaatcacccacagagaccattttcagtgttcttgtgaatttaacctctagtctaaccttttaatgaaaaggctataatatattagagtggcccagaaaggtgaccttatgtctcaggtgtcagagccacacccaggtctcctgattcccaatgatactccctaaagccttacttgctctggctgtagtgttttgagaattggagctgcttttaatcctatggtcagctacacagctgcaggatgggccctagattccctattcaggaattcagatcttaaaacaccaaaagtgataaaagtagatacagttccccttcttcagccaatgcaaggatcctagttacagagaaaaaacggtgtgccaagacaacacccttaattctcacgcatttccccctttctatcttttatacttaccaatttatcagtcccatgatctgtcttcacctcagaactaagtggaagaaataagtctgttgtatgctctgggggaggtacctccccaagaactatcaacccctgcaggatagagaggagaaaaatagcataagtgagcagtataaacttcaaatttaatttaggagttaagtctcaaaaggactgttggtgtactagaggccccctcttcctcaccctatggttcagaaacaaactacagcagcagcagctttgttttcccaaagagctatttcaacaagcagcagacccaggctcccctctctgccacttgactgctctgacctacatggctcatcagccatttagcatctttattcatatctttcagatatgaaatctttaccagattatggcatttataccatattactagactccactagattaacagcagcaatgcagtttttgtagccaacaaatgcagtttatgacttactaagctgaaaatgctactattcttaatcatgtactccaccaactatacctgcacaaacaaaactgaatgaaacaaatgtggaacagtcccctacaatttatgagaaaccaagagcttcttaaaagctggcccaaaggaacctgcttttttcataagcataaatattacttcagattaagttcctgcttgacaatttcaaattcagacctttggaaattcattccaggaaacaatttacataaaaagaaattaaaaatgaacccacaagtcctccccattgtacatataatgagccaggatgggtaaaggcagaaggtatcttattattaaaaaaacaaaatactacatatgaatcccaccatgtataccagaagaggtgacaaaaataaggctatgacactatataaccgaaagactgggatgcaagtgatcagggttcccaatctctttctctggtctaaaaaatagagatctaactagattaagaagctcttaatggaaatttattatcagaatcacctggggaaccttatcaaactatactggcttaggtccaacatctactcagtacctctgggggtggggccaggtagtctacctttttatgggggaagggaggcaggacatggtgggtacatggaggtgggtgtctctctcctcccccaccccgccaaccccactatgttaccgaggctgatctcaaactcctgggctccagcaatcctcccacctcagcctctggagtagctgggatgacaggtgcctaccaccatgcccagaggtggatattctactattctttaaaagctcccctggtaagtcctaaacttgtaaagttgaaaaacactagacttgattagtttgggctcaaagaacatcctaaagtatagatttgggggactagggattgtgactattagtcttagctctctaggccatacgacagactcttatgagccactaaaccagatgatccatccctggggtccttgtaactaaaaaaccaatatgaaatacaagctgcagaaaaggggaaaacattaagaaagaaaaatggaattttatttcagtttttaaaaaagaagtatgtatctctttttctcttgaagcaaaagaagcactgcctccctattctggaatatgactacacttagcctgtatcaaaaatgaattggagggtcccggaatggcggctcacacctgtaatcccagcactttgggaagctgaggcgggtggatcacctgaggtcgtcaggagttcaagatcagcctggccaacatggtgaaaccccatctctactaaaaatacaaaaattgcccaggcgtcgtggcacatgcccatagtcccagctactcggaaggctgaagaaggagaatcgcttgaactcaggaggcagaggttgcaatgagccaagatcacaccattgcacaccagcctgggcgacagaccaaggctctatctccaacaacaacaacaacaacaacaaaaatgaattggaggctgggtgtggtagatcacacctgtaatcctagcacttggggaggttgaggttaggagtgcgagaccagcctggccgacacagtgaaacaacgtctccagtaaaaatacaaaaaatagctgggcgtggtggtgagcccctgtaatcccagctacttgggaggctgaggcaggagaatcgcttgaacctgggaggtgtaggttgcagtgagccaagactgtgccattgcactccagtctgggcaacgagagcgaaactccacctcaaaattttaaaaattaaaaaaaaaaaaaaaaaaaaaaaaaagaattggagtctcctcagaaacaagagaaaggccattaactagtaagcaagaaacattaaccctagcctttaaaatgaggtttctctggttaaagaacttctgcttcaaaatattttcttccctaaatcaaaagcataaaatataccttacaaactttatcacatccaaataaaaactatttgcaaaagacagttatcttgtacaccactgccttctcaaaacgttgtattcaacagatattccctacttaagggcccaaactgtcttcctgcttcctgtacaaagcatgccaaaaatcattttattattcaaattttcccataaccggttcctaagaacttttttaaagatcaatttccaactactttccccaaatatttgttagtgttataccaatctcatcatctcctagacaaatgtttcaatgaatgtgaagctgttgctgctgctggaggtaagggttattagtcagtagaaggttaaaaaaaactgaattaaaggttaacacatgagctgttcatctttatttatactcatttttatattttatcagtccaaattgccgttcgtccttccaaagagattttcaacaagtcccacctccttccaagaaaatgtcccgggttaatgagttcctacttgctttatccacactgccagacctcctaaagcacggtgattgtatcttactttctgtgtatttaaatctcatttccagagcattcataatcttatgccacattatttatttcacttattattgcctcagtttcttgtttgttgagacagggtcaagctctgtcacctgtgctggagtgcagtggtgtggtcacgaatcactgtaacctccccctcccgggctcaagtgatcctcccacctcaaccccataaatagctgggataacaggtgcatgccaccacatccagctaatttttgtatttttttggtagagatggggtttcaccaagttgctcaggctggtctcgaactcttggactcaagtaatgcacttgcctcaaactcccaaagtgctgggataacaggtgcaagccaccacacccagctaattgttctattttttggtagagatggactttcaccatgttgccaaggctcgtctcaaactcctagactcaagcaatccacctgcctcggcctctcaaagtgctgggattacatgtgcaagccgctgcacccagcctttaattgttaactaatgttagtttattgaagatgtggacaaaatacaaatatatttaaatgacccatgtcccttagcagagtcatacaccaagaaaataaatgcatagcaaatatttgttgagttgtataatttttttcctaacaggaaaatattaactttataataattatagccagaagataaataaatctaacaattagatataaaattactccttcaatttttctttttcagttatatgaaagtaaggacgcagtcagtattttccaaagggaagaatttttccttaaactacagaataatttctaaatacaaccctcagatagattatgaagacatctcctaagagagtataataaaacttggtagggaccatctattcatcgacataattttatagacccacagaggatgtaggtcaaagcttatgtctctacaggccaatacatggcagaactggggcaaaagtctgcatctaactaatatttcattcctcttttgttcagttaattcaatcatttatccgctcatcagcatttgttaggtactaaggatacaagaaaaaatgagagacctatccctctcccctaacccatccttcaaagtgcttattacgttctaatactgcggcaaagaaaaacaatgtaaataggtaaatgttatgtactacattagaaggtattaaatgctagagagaacaaaatataggatagtgaggggattaagaagtggaaatggtggggttggtcgtgacggctcatgcctgtaattccagcactttgggaagccaatggaggaggactgcttgaggccaggagttcaggaccagcctgggcgacgtggcaaaaccctgtctccacaaaaacaataataataaaaattagcctggtgtaatatcacacctgtagttccagatattcaggaggatcacttaagcccaggagagagagagagatacaagtgggagggggtactacaggcgcataccaccacgcctggctagttttttgtatttttagtagagaaggggtttcaccatgttgccaaggctggttgcaaactcttggggccaagagatctacccgccctggcctcccaaagtgccgggttgcaggcatgagccactgtgcccctgcttgaatgtttatttgaagacagaatcaaccagctatgccaatgtgcttacaagataggagggaaaagagtcagagacactgccaaggtttctagcttccacaaccagaagaatggaactcttcttcatttgttcagaggacatttgaatacacattagttttaattaaacctatttttgaaaatatgtgctcaagtgttacactgaagcaaccaacaatcatccatacactgtccattgcccccaagatatgtaagttcactatggcattcaaaaccaaacactggatcctctaatttaatactgtacctcacaccaaaaaggatgaaaacagctaaaaagaggctgagcaaataaaaagcatccaagtaggtaagagtcattcatgcaggtagcatctattgagtggctaccacgtgcaaggtagtgtgaaaacacagtaataaaataaaaacagattctaccataaggagcttatgttcatctagccttgaacagacaaagagacaaagtattatgacagtactataacagaagttgagagaaggtgatgtcagagcagaaaagagcctaactgaagagactgatgaaagtgaggctttacagaggaggtctacataattacttaacattccccaaaatatatttaatatattttgagctatacttattcattaactatacacttaatgactttgcccttttctgtatacaatgtttcatatgccacaataacacttatttcggataaagtttactcatgtttaataaccatgaaaagaaaggttagcattagctgagaaaacttcataatgttctactccacacctgtcatgctaccccaacatgggcttccctaacattccaggtttaaactgggtcagtgttgaatagctgtgccattagcctggtggcaataaacttagggctgctgtactatgaaatagcaaccggtagaagccgaagaaaaaggtcaagagtctccttttccttcgccatgtcccgagtcagagccaggatcatgcttaggctgcacaggcctagaaaactccaagagtgaagcaagcttctgctttacacaaggaccaaaggaactggaatgggtcacagttacatgcagccttaatacctcctaagtgactcctctgtggatgaaccctctctcaactgtatttgcaatacagctaacaggcaatttcacatacttccttacatcactctatcaggtcaatcttccctatgcatctcaagacaaaccagtgaccccactgcagaccagttccacaagaatcaccctgggctacctggaaaagataagttgtctaaagtgctttaaaaaaccctattaagatgagaacttcaacagctttatgaaaattttgaagagaaaggtgttataagcttctgcagttcccattcaactccttccctattcaaaagtttcaatgctcttccacctcccatcctcaataacatttccatcctcagctacagctgtgtaatctcaaagagtagtcagaagaggagattttaaaaaacaacgtaagagtcaagccagtgcttctgggaggccaaggcaaggaggatcacttgaggtcaagagtttgagaccagcctggacaacacagcgagaccccatcctttaaaataaaaaaaaccctttaacaattagctaagcatggtgggacttgcctatggtcccagctacttgtacttgcaaggctaaggtaggaggatagcttgagcccaggagtttcaggttacaaagaactatgatctggccattgcacctcagcctgggcaacagagcaagaccctgcctcttaaaaactgcttagtccctattctttcccctcatttaccaggtgtgaaatttcaacaaacatgtttcagtgaaatgatgaaaaggacacaacagcaaagtatgttagaaaaaaaatgctttggaatcagataaaaagtcctgagtttaaatttagctctgccttttacaagcctctgaagatttattctgatcattaaacgaacatacatgagtaaacctttaattagtatacactcaaggtacgtatattgttttcgtttctccttctaaagcatggaagagtttctttttaaaaaacaagctgacaaactatgaaaattaaaagagtacaacagcatgcagaagtagtacagaggagttcctagaagttatattctttctccagagagcaatattattcccaaaagggactctactcacttcacagcttggaaggtaatacctaccttctgacagaacagaaactggtgtctggatcctagaatcacctagcagtagtcacaaatactttttttttttttggtaatacgccacttaaataaaattaatgttaataagcaacaaagtaaatccttaaaaagaaaagccccaccatccctccaatctcccacccgaagacaaattataactcaacagcctatcaccaagattcagcctatcacctaggttcatctcaaaaaaaaaaaaaagacctgtgcaacccaggaagtgctgggaaatcttggtgcagcatggaaaatatgaacaccaacccacttaaccaaaacacataggaaaaactttcttccatttcagtaactaaaaaaaaaacccaagcacttaaagtgattactaacttgagcaatagctctgcactcacttggatgtgtaaccatgaacaaactacttgactgctctgatcttccattgtttatcttgaaaatcgtgaatgagagtaaaatgcttagcacagtgcctgacatatcacaagtgctcaaaaacttctattaattatagtgttacataaagactaaatgcatgtgaatatatcattgggggaaaattccatggcttgttagagcaagttgaatattgtctcttccaaatttatgttcacccagaacctgtgactatgaccttgtttagaaaaagggtctttgcagatgtaatcaagttatgaagagccatttagtgtgggctctaaattcaatatgactggtgtcctcctgacatggaaatctacacagatgcaaagagaaagatggtcatatgaagatggaggcagcaactgcagtgatgtagctacaggccaagaacaccaaggactagcacaatatcagaagctggaaaaagacaaggaaggattcttccctagagcctccatagagaccatggcccttttgacaccataatttcagacttctggcctccagaacggtgagagaacacatttctgattttttaagccatcccatttgtgatagtttgttatgacagtctaggaaactaatccatttgttgaaaaagaaatgtataaatacgacacgtaaagctgtgaattttcttgatgcattacttattggaactatcaacctagttttattcttcctatcggaactctgagaagtaaaagattatctatgatgttgtattttacagaccaagaatctgaagctcagaaatgttaagtgacttttcttctcaaggttcatgtaagcagctggtagcaaagccacgattagaaacaaaaatttaccaagtccaagtatggtgcttaatacaatacgctttgaatgatgaaactcttggataagcaacatacattcatgtgccaaatagcattatggtcaatgacagaccacatatacaatgatggtcttataagattttaatacagctgaagaatacctgttttagcacaaagcactactcctgtgtttgtggtgatgctggtgtaaagaaacctacagtgctgctattagaagtataccacatacaattatgtacactaagaatataatagctgataataaaagctatgttactgttacacttatttcttatgataataaaaagtgttatgtatttactatactatacttttaatcgttattttagagagtacttctactcattaaaagaagtgaactgtgaaacagcctccagcaggtccttctgttggcactgtcacaggcaatgaaagctccgtgtgtgttgttggccctgaaaacctaacagtgtaacaagatgtgaaggtggaagacagtaataccgacaaacctgaccccatgtgggcctacgttcatgtgtgtgtttgtgtcttagtttttagcaaaacagtttaaaaaataaaactttcattttaaaatggaaagttttaaagatagaaaaaagcttgtagaataaggtgtgaagaaaatatttttgtacaattacaatgtatttgtgttttaggctaagtgttattacaaaagagtcaaaaagttttaaaaacttaaaagtttataaagcaaaaagttatagtaagctaaggttaatttattattgaaaaaaatatttaaaataaatgtagtgtagcctcggtgtacagtatttataaagtttatagtagtgtacagtcatgtcccaggcttttcaatttcagttacccttcacccaccgactcacccagagcaacttccagtcctgcaagctccattcatggtaagtgccctatacaggtgtaccatttttatcttttctactacatttttactgtattttttctatgtttaggtatgtttaaatacataaatctttaccactaattgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatatgagacagagactcgctctgctttgcccaggctggagtgcagtgtcgcgatctcagctcactgcaccctgtctcccaggttcaagtgattctcctgtctcagcctcccgagtagctgggattacaggcacccgccaccacacctggctaatttttttgtatttttcatagagacaggggtttcaccatgttggccaggctagtctcgaactcctcacctcaggtgacccacccaccttggactcccatgcctcggcctcccaaagtgctgagattacaggcgtgagccactgcgcacggccctcagcttgaatttaagtgcactttatgatgttcacgcaccaatgaaatcacctaacaacacatttctcagtttcccttttgttaagcaatgtgtgatggtatatacaaaactccagattattttccagatatttagaaatacttttcagatattttgatattttgaaagtttctgaaaattgctctgtcattacttctgagtgatgagctgaagaataaagcatgaaccaaatgaggtgagtatcttcttatacacagctagtgagactataaactgacactgccaaaatacttctctgaagaatgcattaagaacataaaagagcattcatacctttgactgagataaagatatttatcatggcatatttaatttaaataacaaatgtaacttaaatagtcaacaaagaaagccaatagcatgcagccattaaaaatgttttccaaaaaccaactgggaaatattcagggcacatacgtaacatgactgtatttgaacaaattacttatgtgctaggaaaatgtaccataatgttggtagcgagataattttgagctgttgggttgttttttttttttttggggggggggggagggtgggtgtcttttatacttctatgtcatttcagtttcctgagaattgatacacagtatttcatcaattctaagaggtactctccccacatgtcaacaacttttaaatcaagatgcattttacaatttctgttatgccctggtttaactgaaataatttctttgtcgtacttaaaacaatggtacatcttacaatcaatagcatcttaagttctatgaaatgtagcagttttataacaaggaactaagatgatataacatatacacatatataaacccacatatatatttatgaatgtatataaaaagatgaagcagcacttatgactactattatactaatctcagttgttactaagagactctagttctcaaatatagaaaatcccacttaactactggctataaaaacctagaaacagacactgaagaggtgtctctgatagagaaagactgtgtttttctcctcagtacaggcatatccagtcacctcctagttattcttagtcatcattccagttcaagttctacaaatctcactttaaaatttcctttgtgaagacttgggaaagcaaaatatgcaccaaatctagaatgtttattagttttgttccagctaatttttaaataagtaaatcaggatttaatttgtatgctaccctaagggaacaaactagtaagaataaaaaagtgagccctctggactgtgtcctcaattaaagtatgctctattgaacttttagggggagggggaatatatatatatatatgtatctccaatctggaaagaagctataagtccgcagtgacatttttagaataaaagtttaaatgattagatagcccacagaactttcacttcaaaccctgatcattctgttcattttatcagttgatcaaccttcaacttttggcctactaatttaatggatactgttcacaggaaagccattttcttaaggctttgactagtactaaggtcaaaaaggcattttgacccttatttttagtagcaatagactttttctagacatgggtctacataaagatagagctcagccacaccaagctaatataaaaaatactttgcaagaatgtaagcttcatgaaggtaggatttttgagaacactgctgagacacagtaagcacttaaaataatggtacatcttaccatcagtagcatcttaagttctatgaaatgtggcagttttataacagggaactaacaaatataaatctaacaaatatgacagttaacatcaatggcttgcttgcattattcagtctgttttccttgtttcctgttagctcagatacccacacagttttgttctaaatacacgttcagttaaacattatattctaatagtgttttcctttttatgagacaggcctttcttagttgtccaggctggagtgtggtggcacaatcttggctcactgcaacctccacttcgtgggctcaagcgatactcccacttcagcctcctaagtagctgggactacaggcacatgctatcatgctcaactaatttttgtaatttttgtaaagacaaggtctcactatgttgcccaggctggtctcgaactcctgagctcaaatgatcctcctgccttggcctcccaaagtgctgggatcacaagagtgagccaccacgcgcagccacatcaggttcttaaattaaaccactatatcaggtcattaaaccatttactttgcaatagttaagaagagggttatgggggttacgaggtgggaggggatgtgagaaaagcgatattgatagttttcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaagacaggtggtaaacgattcttcactccaactagaaaggaaaaaatgacaacatactatgaaaaaagctatgaggcaggaaaaagcacacgtcaaggcatggagatacggatatagactaggtaattttgcaaccacataagtgaaagaaaatttgctatccaatcttcctattctctactcccaagagcctagtgcttttgtatagttttcagctcagtaaagtgcctccagatttataaaagctcaatgacaataacaaggtatctttattacaaaatagttgttaaaagtttgattcgaaaaattttaaggaaacctttcaggtaactgaaagtggagggtaggggcgcgactcatgaaggagttttttaaccaaagaaatgatatgatacatttttaaatgaccacttcagttgcaatataaaataacagattttggaggaaaatgtcaatacaaggatatcaattatcaattattaggttactatattggttcaaggagagatgatggtggctgtggagatgagtgaaatcaacagatccaagatatattttagagagtattgtagaagactaggaatgggagtgaccagacaggaatgaagacttctagacttactgcacactgtcatgaggaaggatggggatggaagggtacagtggaataagctgggttttagcagaaggaatcaagagccccattacaaacacattaaatggcctggcgtggtggctcacgcctgtactcccagcactttgggaggctgaggcaggcggatcacctgaggtcaggagtttgagaccagcctgaccaacattgagaaaccttgtctctactaaaaatacaaaactagctgagcgtggtggcaggtgcctgtaatcccagctactggggaggctgaggtgggagaatcgcttggaccctggaggtggaagttgcagtgagctgaggtcgcgccactgcactacagcctgggcaacaagaacaaaactccatctcaaaaaataaaaaataaataaaaataaacacattaaacgtttataatgtatttacaagactaacaatcagataaagtctgaacttcagaaaggagatagagctgacctgaaaatataaattacgaactattgttatatgaatgttacttaaaagacgaggaggccaggtgtggtggctcatgcctgtaatcccagcactttgggaggccgaggcaggtggatcacttgaggtcaggagttcaagaccagcctggccaacatggcgaaaccccacctctaccaaaaaaaaaatacaaaaattaatcgagcacggtggcatgcacctgtcagcccagctactcaggaggctgaggcaggagaatcacttcaatctggaaggcggaagctgcagtgagctaaggtggtgccactgcactccagcctgggcaacagagtgagactcggtctccaaaaaaaaaagggcagaagatggggcggaagaatagagataggaaagaggaggatgttgagaactaaaccctgaggtacttttagtattcaaagtgtaggggggtctggaaatcttgtagagaccagtaggggttggagtatgacatcttccaataatgaattctcgttgctgtccccttatgggtctgggtctacctgatagtctcttctggaagtcggtatcacttgtgcttaatttctactcttttgtgccctctatacagcctctactacaaatcttttttgaagaagcacagggagaaataacttggggaaaaaaaaaagcctatcttttagaaatagattctgaaatatttacagatgaaataatatgttgtacagaattggcttcaaaatagtccaagtaaggggtggtctagataaaaaaaaaaagaacagctctgagtagatgcctgttacagttgggcaatgcacacatgggaaggttcactgcactggtctctctgaatatttcacaataaaacataaaacatagtatggaaggttggcaaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcgtagcccgggcggattcagccccacaaaatgggcgcagtttgcaaacagccccccggcctgggcgccgagggccagcggcgggcgggggcgcgcgacggcggctccggcccgggcccgccgctctcctccccccgacgcccggagccgccctgactttccgggcgggggggcgaggcagagggggaggggaaggcggcggcggggagcggctgctttttcttctctttcgggccctttcccggccttgctccgcaccgacggggcccgagcacggctggagaccgcagcccggccgggagggcgggcgggcgggggcagagagtgaaaccgcccccccgccccgcacaaacaagcaccgccgtctgcagcccgaacccgcacccaggccgccacccccggccgcctctttccagccggggagcgcgcttcagccgccccccgcgccgccgcggcgagacgagtcggcttcgctacggtgctcggttctcccgccggctcggcgagcggtggcggcggtggcggcggcactgggaaaatggcggccgagctccttttccctccccccctttaatctgaagcggagggagaatggagcgagcgagcaagcgggcgagcgccggggacacggggaggagggacagcagcgcctccgccggctgcggctgcggcggcgaagggccgctccaccccggcgcgccgccagggggcgcccgccgcgccgcccccgcgggccgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggtgagtctaacctgaggcactgacgccgtcacatgccctccgtgctggggccggcggtgcggctcgccagttgaggggcagggcgggccggcgccgcggagcgagaggacgtgagcgaggaactgtttgcactgtgtagtaaagagggtaaggccgtcggcaccacactattccaaggctaaccctgcagaaagctccctgaccagtgaagcggcttccgccgcccgccctttgtccctagcagccagcctccgtatactgcagcacggctgggcactagccccagcaccgcgctccgcagccaccagagttgggcggggtggggagggtgcacgtagtcactgcgcaggccccagccagggcccgcgccgggccagcccgggaagggacagccgggagccagaggggaagtgatggccccgccggcgccgggcccgctgggaactgtagttttcgtgaagaaacacgcgtcttgttttgggtgtcatggcttggcagatccgccaaaacaggcaaatggcattacacaatgagtatttatgcttcctgccgccaccaaaaggaagttcactgccatgctaaaagtttaacaaagaactccataaagaaacacaagtctcacaacaaaaagccaacttcccacctcgttaccagagttggtttaaagtggtggcaccttatcatttctcatgaccagtttatcagtacagaactttatattgtccccaaaataggacctttaaaataatggaacctttcctagacttaaagaattcataaacataatgtaatacaaagtgtcacacaaagtgtaattctaccaccctttaaagttgccaaaagatgagtggagtatcttgagatttaaaagactaatctaggattcatcaaaactggcttaaatgactgaagaaaaaatcgttcaaatcattaaatcatcaaattcggcagataagaagggtatgtatgctctactaccaaaaaggaagacgcaaaatgcttcacacttttttgtggcttaccagaaccaatatccggcattatacgtcacttctgcttatcaaaaaacaccctcacagtcgttacagaacggttttagtcttcccacaaagttacactaactcacctgcccctgcaacatctgcacctaggtttctgcgaatttccatttgtactcctaaaatcacactctcaagcatagtcatagttctcaaataccaaaggcaggcagtttggagtcatagggtcaaattacacaaagaataaactaatatttgtatacacatccaaaagaggtctttagtcttggatttttaatttacaaccctggggaaaaactttgacttttttattgtacacacatacacacataaatagtaattccacaaaatacagtagaagggtattggaccaacagatggcgaactagagccccaatctgaggctcctgaaatctaaattagcagaatgaaaaataccaaataaggcaaagccctttgcagcgtatacttaaatattaaattcagacacaccataacaaaataatcttactgctgctccaaatttttaagactgaactgtcagatttaattaggcaaccaaataagcaagattatatgaaatatatttttctaatggattaggagaaaactggaaaatgctcatttttaaaaccatgtatttgggggaactataaattccagtttcccctttctctcattgcttagtgcaagagtcaagagttcacagggtttatggcacttaaatcagtcaacctgttgtatattcttatctaaaatcagacatctttcttattaggcatccacttgtacttttatttttttgacagggtcctgctcggttgcccaggctagagtgcagtggtgcaatcaaactcactgcagcctcccaggctcaggcgatcctacctcagcctcttgagtagctggcactacaggcatatgccaccatgcccagctgttatttttttcactcctttttgttttggtagatacagagtctccctatgttgcccaggctggtctcgaactcctggactcgagtgctggcattacaggcatgagccaccacacaaaaatcttatgaagagaaacaaattttcttaaatttccccccaaaaaatagtggatgtccaaaaggctgattgaaaacacctacatacaaaataaaacaaacaaacaaaaaaagatttaaagaaaaaggcctggtgcagcagctcactcctgtaatcccagcactttgggagggtgaggtgggaggatcacttgagctccggagttagagaccagcctgggcaacagagtgagaccctatctctacaaacaaaattttaaattagccaagtgtggtagcatgtgcttacagtcccagctactccagaagctgaggggattgcttgagcctgggaggtcaaggctgcagtgagtcatgatcatgccattgtagtccaacctgggcaacagagcgagaccatctcaaaatgaaaagtgataaaaaaataaaaacaccaacatatttcaaatcactcttggaatagtcatgttgactctccaatatccactctattctgattagttttaacccattctctttgccaatgattggttaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagcctgaagatgccaccaacatcaaagggaatagagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaatgattgagttctaatgttttttagtatttgtatcttactttatgattacagtattttatataactaatcttattatttcttcctcagaaaagacattccatggccaggcatggtggctcacacctataatcccagcactttgagaggccaatgtgagagtattgcttgagcccaggagtttgagaacagcccagggaaaacagcaaaacttcatctcttcaaaaaataaataataaaaaaatttagccgggggtggtggcatacacctgtagtccaagctactcagaggctcaggcaggaggatcacttgagcccaggaggtcaaggctgcagtgaaccatgatcacgccactgcaaaccagcctgggcaacagagcaacaccccgtctccaaaaaaagaaaaagaaaggaagggaggaaggaaagaaagaaaaaaggaaaaggtgttccctcttacacacagctctgtatccatccatctttgtctgtgttctctctacctagaaaaagaggaccatccctcattaccaccattccttgttaattcctctctccaatccacctacaactcatgttatcctcttatattccaccacaccactgttatcgtctactcacttcacttgacaataatgtaggctgggcgtggtggctcatgcctgtaatcccagcactctggaaggccaaggcaggcagatcacctgaggccaggaattcgagaccagcctggccaacatggtgaaaccccgcctctactaaaaatacaaaaagtagccaagcatggtggtgcacgcctgtagttccagctactcgggaggctgaggcatgagaatcacttgagcccggaaggcagaggttgcagtgagccaagatcacaccactgcactccagcctacgcgacagaaggagactgtgtctcaaaaaaagaaccaataatgtacagagttggcactacattacccttggttaaatgctgtctgtaattcctctgagtttgttttcatataccagtcttgccacctcaagccagcctgaaagcccttgcaggcaggaactgtggttgttctaatttaagatctgtaactcatctatagataataaacgtattccaaaaaggcactctctaccttccctgccacagaccttctaaacaagccagaaattcctaaacagaataatctcacaaattcagtacctcgtatgtccaaactaatctcaaaaggacaatgaataactttttttgcacttaagaaaaagcaattattatatattaactcaggacaagttctaaagcctaggccatttagtttcaaaagcacaggggcccatttttttggttacttacctaggacctagcccagggcctggcacaaaagagacacatcataagaactgactgaataaatgaaaaaggtagagtgtagtacttaagcacacaggacctaggtagcccgattctaatcctgcctccctcacttattctttgtgttactttgggcaaagtacgtattctgctctgtaaaatggagatagtaataccacctacctcttaagtttaactattattattagtgaatgaagctattttccacagttctaaactttaaaggttaaaatctgagtgaagcaaaaatcagcacctctttcctaattcaaacttcaaacacctatctacttaggacttggacctactttaattaaaaaaaaaaaaaaaaaaaaaaaaaaagcctggatgtggtgactcacacctgtaattctagcactttgggagaccgaagcaagtggatcacctgaggcctggagtctgagaccagcctgggcaacatggtgaaaccctgtctcaactaaaaatacaaaaattagcctggcattgtggcacatgcctatagtcctagctacttgggaggctgaggcaggagaatcgcttgaacccacaaggtggaggatgcagtgagccaagatcgcaccactgcactccaacctgagtgacagagcgggactctgtttcaaaaacaaaatccctgtctagactctagcaaacaatgttttcattcatgaacttagataacactatatataaaaatacttttagctccctaaaaacatattctgagaatgattatttacaatcataaatctaatgccacattaaatacttcaaatacatttaattcaacaaaaatctagtgagtacctattaagctcaagaatttattctagatatcacagaaatgaacacataaacctatgtaaaaacccatattaaaattataaaagaaacatctttaagctgaaactgaggcatgttctcacattaatatttaaccagctaaatattaaatagccagagtcaactaaaccaaagttaagaaatttaagtcaaaaaatttaggatgtagaaggaatatgttcagccgccacattttattagtgtgaaaatgaggccaacagaaagaagccagttaagagattgccaaagcgtcaaagctggaatcagggtctctcagtcttcaattctcacttttcccacttctaattcaccagtgctactcaattggtgaactggatgtgcaaacatgctaaaggcattaaacctaaaccatactacctatttcacagtgtcacaagtataaagatttagccaaatgcaagtagaagaaaatcctcatactgattacaatgactacaaagctcagaaatcaagattttttttcattaaatggaggccttagctgattcaaaatatcatacagtatttttatgtactgactgaatccagtagaaacaaactttcagtaagattaaacaaaagcatttcataaatggcaaagtattacaagaatgcatagcattccttcatttcaatccaacctaacaagatattttcctcctcatactactgatacaaactgcaggatttacataaagatattattttgccatctcaccacagaactgacccaataattcatacaaaagaaaaactaattattaggcagcctcctaatttaactgtgttagtaatgagaacaatactgttgtaggttaaacctaaatgtactagtaagtctagaaataatttactttaggataattcagaagacaacattaaagctcagctgaatacaattatatcactgaaagaaacaagtcaggttctctcaggccatcagctattgttaaaatctaacacccaagattgttggtcttctccacagtggtggatttaatagcagctaccagcactcatttctagtgcaagcagtttaagcaggattttatacgaacattttaataaagttcctcaatgagtttacacacacacacacacacacacacacaccctgattattttggtgaattttagttaattctaatgtttttaactttagaatattttaaaattctcaaataactagaatgtgtgaacgttcaatgaccaaacatagaaggagtattctaatatactgattttgcagattaagcaatctacgcaggacccaaactttttatcagataataaagctgagtgtcagaatttggccaaaatgtaccaagaaactacctgagttcttttccaaaggaaacataaaggtaaatatgcagaacttcaaggcagctgtgagcagccaagttgtggagggcctgacaaaagtgagtcagaagggaaaatgttcaaagagaaaaggaggcagcaggtgtacaaggcaaaacacaccttaaaaaatatctttacaggctgggtgcggtagctcatgcctgtaatcccagcactttgggaggccaaggtgggcagatcacgagatccggagatcgagaccatcctggccaacgtggtgaaactccgtctctactaaaaatacaaaaaattagctgggcatggtggggggcacccgtagtcccagctactcgggaggctgaggcagcagaatggcatgaacctgggaggcggagcttgcagcgagcggagatcacgccagtgcactccagcctgggcgacagagcgaaactctgtctcaaaatatatatatatatatatttttctttttacgtcagttgctgattctaagttatgatgcaacttgtaaaatcttgttctgatggcatggcaaacctagggactttggaagatggcagacctgtttcctccaatgaagcagcataccattcttggaaagggaattactttttttttttttgagacacagtctcactctgctgcccaggctgccaggctggagtgcatggcaaaatctgggctcaccgcaacctccacctcctgggttcaagcgattctcctacctcagctgcccaagtaggtgggactacaggcgcgtaccaccatgcccggctaatctttgtatttttagtagagacggagtttcgccatgttggtcaggctggtctcaaaatcctgacctcaggtgatccgcccatctcagcctcccaaagtactgggattacaggcgtgagccaccacgcccagcctagaacattatttttaacccactaattcttggattcttgaacttgtttctatgtacactcaggaacatacagctacaaacggggagtaaccaaagccactgaatatatgcaggagcaacttttttggagtatcaatttaatcaaggattatagtaaaatcagatatacttttgttaaaataaacacaaatatattacaggttgaccatccctaatctgaaaattcaaaaccctccaaaatctgaaactttttgagtgccaacatgacacctcaaatggaaaattccacacgtgacacctttgcttctgatggttctctgaaccatcagaaacactgtttatttcaagaacaaaattattttaaattttgtataaaactggtcggttgtggtagctcatgcctgtaatcctaacactttgggagaccaagatgggaggatcatttgagccctggagttcaaaaccagcctgggcaacatagtgagaccctatctctgaaaaaaaaaaaaaaattaagtccaggtacagtggctcaggcctgtaatcccaacactggaaagccatggcaggtgaatcacttgagctctggagttcaagaccggcctgggcaatgtagcaaaacctatctctaccaaaaacacaaaaaattagccaggcatggtggcatgcacctgtagtcccagctacacaggaagccaaggtgggagaatcacttgagcctggaaggtggaggctacagtgagcagagatggcgctactgcactccaacctgagtaacagaatcagaccccatctcaaacaaacaaaaaaattagctgggcttggcaccgtgcatctgtaccagttagtaccagctacctgggaggctgaggcaggagaatgacttgagcccaggagttctaggctgctgtgagctaggatcacattactgcactccagcctgggcaacagtatgagacatcatctcttaaagaaaaaggtaaaaaaaagaaattatcttcaggctatgtgcataatgtgtacatgaaacatagaatttcatgtttagatttggatcccatctccaagatagtacattatgtacatgcaaacatcccaaaatctgaaaaatctgaaatccaaaaaacttctggtcccaagcatttcggataagggatattcaatgtatacagagcaaaaggcagaattctcactgtttcaagatagaaaaggagtcctcagagagatatgtcctgcttgtaacaaacagctccaaacagccctagaccctgaaaagtactttaaggaaagataaagaggtactggtttagaccatttatagataaatatgcatggctaaaacccctgaatgtaatccttccaggcagaagataaaacctgaaatctaacgtataaattgtcatgggtacaatattataaaagagaccataagttaccgagaacatgactggaattcaggaaatgctaaaggtcctgtcttatctctgtaactcatttacaaagaaatcatgtatgattttctcaactgcaatcttttttgtttctgaattagactgacaaaaattatagaatataatattcaatattttccaccatattccaaattctcactatcacatttaaacacaattttatctaatgaaatgtgtcccaaatgaaccaactttaaccagcatcagaaaaaataaaataaaatagttaaatgaaactgtatcttctttggtataagaagtccttcaggccagacgtggtggctcacatctctaatactagcactttgggaggccgaggccagtggtttgctagaactcaggagttcgagaccagcctgggcaacatggtgaaaacccgtctctactaaaatacaaaaaattagccaggcgtggtggcatgcgcctgtagtcccagctactcgggaggctgaagcaggagaattgcttgaacccagcgggaggtagaggttgcagtgtcagtgagctgagatcgcgccactgcactccagcctgaacgacagagcagactccgtctcaaaaaaaaagaaagaaatccttcagcacagagggtaggaaaaaacaactactcacacttcccagaatacctaccgtggcaataccaaaatatgaccatgcttgttaatatttgggctacggcattaaatgtttataacataacacaaacacttgtaatccaaatgtgaatgattatcttcaattttcagtaaaataagaccctataaaagccctaccattaatacatattcattcataaacatactgagtaccagtggatgttaaacactgtagaatctctaaggaaagaatactcggtcactttataagctatgtggtagtcaagaaaaatcctttctactcattgatacgttaaatgatcaaaaaatccaaagctaaaaaatgatcagagaacaatgaaaaaattttagtggctttatgcttccaattccattttcttctggactcttttctgaagcttgcctaaatcatcccaggaatgctaaaattgggtgttatttatggcataaccaaaatgaaataacaaagtaagtaccccaaataaaactaggagaaaaaatccagggaaccaagcaggcagtaaggatctaaagttctatacttggaacctctaccctgaatgttaaataatagatgttttttaaatagttgactaccaagtgtggtggcatgtgcctgtaatcctagctacttgggaggctgaggtggagagactacttgagcctaggagttctagactagtctggacaaatagcaagaccctgtctcacgggtaggggagcaggggaaggcaaccaagctgggtgtgccatgtgcctctagtcccagctacttgggaggctgagacaggaggagtgcttgaaaccataggccactgtactccagcctaggcaacataggaagaccctatctctaaaacaaacataaacaaaaaggccgggtgtggtggctcacacctgtaatcccagcacttgaggaggctgagttgggaggatcacttgaggtcaggagttcgagaccagcctggccaacatgataaaatttttgtatctttagtctctactaaaaacaaaaattagctgagtgtggtggcaggggcctgtaatcctagctacttgggaggctgaggcataagaatcatttgaacctgggaagtggaggttgcagtgagcggagatcacaccactgcactccagcctgggtaacagagcaagactctatctcaaaaaaacaaacagttatatctttaattattatcttcattcagtaattaggcaattagaatttacaattgctaaatgaatgttcaaagttcaaccaaaattagtccaagatgaagccaagaacacatctcaactcattcaataaagccattattactctgatgccaaaaccagacatagatatcacaagacaactacagaccaatatatcttatgaatacagatgtaaaagtcctcaacaaagcaaaatgaatccagcaacatattaaaaggcttatacaccattgctaagtatgacttaatcccagggattcaaggttggcttaacttctgaaaatcaattaatgtaatacaccatattaataaaggatacaaaccacatgatcatttgaatagatgcagaaaaagcacttaacaaaatccaacatgctttcatgataaaaacactcaacaaagtagaaattgaagaaaacatcttcaatctaataaaaaatacctatgggggaaaaaaagaatacctacaaaaaccccatagctaaaatcatacttaatggagaaagcctgaatgctttctccctcaggtcaagaacaaaacaaggatatccactcttaccactctgtttaacactgcactgaaggttatggccagggcaaataggcaagaaaaagaaataaaaatcactcaggcttaaaaaaaagaaggaaaactacctttatttgcagatgatataatcttgtatatagaaaatcctaagaaaatcccacaaataaactattagagccaataaacacatccaacacagttacaggatacaagctcaatatacaagtagtaatcgtatttctatacacaagcaataagcaatctgaacatgaaaagtttttaaaaattccacttacaatagcatccccccgccaaaaaaaaaagacttagaaagccaagcacgatggctcacacctgtaatcccagcactttgggaggccgaggcaggcggatcacttgaggtcaggagttcaagactagcctagccaacgtggtgaaaccccgtctctactaaaatataaaaattagttgggtgtggtggcaggtgcctgtaatcccagctactcaggaggctgaggcagtggaatcacttgaacccaggaggcggaggttgcaatgagccgagatcacaccactgtactttagcctaggtgacagaatgagacactgtctcaaaaaaaaaaaaaaaaaagacttagaaataaatttaacaaaagcagtgacaatcttatactctgagatatataaaaattacaaaagaagttacagaaatcctaactaaatggaaaggccaggtgtgatggctcacacctgtaatcccagcactttggtagactgaagtgggtgggctgcttgagcgcagaagttcaggatcagactaggcaacatggcaagaactcatctctacaaaaatacaaaaatgagctagatgtggtggcatgcacctgtaatcctagctgcttggggggctgaggagggaagatcacttgagcctagtaggttacagctgcagtgagccatgattgcattactgtacttcactgcagcctggatgacagaacaagactgtgtcccccaaaaaaaaaaaaaaaaaaaaaaggaaagatatcccatgttcatggatgagaatggatcagaagatacaactctgttaaaatggcaatattccctaaattgatctacagaatcaatgtgatcccagcatacccaaaagaaatttgaataggaaaaacaaagttgggggactcacacttcctgatttgaaaacataattcaaagctatggaaatcaagacagtgtggtagtggcataaggataaacatacagatcaatggaatataagtgtgggttcagaaataaacctttacactgacagtcaattgattttatgacaaaaatgccaagacaattcagtggaggaaagaatggtctttttaagccaagtgctgtagctgacacctataatcccagcatttggggaggctgagacaggaggattgcttgaggccaggagtttgagactagccagggcaacaaagcaagacccccatctctacaagaaacaaacaatggtcttttcaacaaaccatgctgggacaactgaatattcacatgcagtagaatgaagctggaccactatatctcacaccatacacaaaaattaattctaattaaatttaaacacggattatagacctaaatgtaacagctaaaacaataaaattcctagaagaaaacaaagctaatcttcatttcatttggtggcctgacatcaaaaccacatgcaacaaaggaaaaaacaagtaaatttggcttcatcagaattataacattttgtacattaaaggacaccatcaagaaattgaaaacacaacccatagatgggagaaaatatttgcaaatcatgtatctcacaagggatttgtatctagtatatttaaagaactcttacaactcaacaataaaaagagaatccaattttaaaatgggcaaaggctgagcatggtggctcacaccagaaggagaggatcccttgaggcaaggattctgagacctgccagagcaatatagcaagaccctgtctctacaaaataaattaataataataaaaaaaaacaattagccaggcatggtggcacacacctgtagtcctagctactcaggagcttgaggcagaaggaacccttgagtccaggagtttgaagttccagaaactatgattgggccgggtgcggtggctcacgcctgtaatcctagcactttgggagtccaaggcgggtggatcatgaggtcaggagttcaagaccaacctggccaagatggtgaaaccccatctctactaaaaatacaaaaattagctgggcgtggtggtgggtgcctctaatcccagctacttgggaggctgaggcagagaatcacttgaacccaggaggcagagattgcagtgagccaagatagtgccactgaactccagcctgggtgacagagcaagactccatctccaaaaaaaaaaaaaaagaaaagaaaactgcgattggccactgcactctagccagagtgacagagcaagacctagcctaaaaaacaatagtgtataaaaataaaattaaaatgtgcagagaatttaaatagacatttctccaaagaagatatatgaatggccaataagcacatgaaaagatctcatcaggttgagcacaggggatcaggcctgtaatcccaacactttgggaggccaaggtgcggggactgcttgagctcaggagtttgagaccagcctgggcaacatggtaaaaccccatctctacaaaaaatacaaaaaggccaggtacagtggctcatgcctttaatcccagcactttgggaggctgaggcgggtggatcacctgatgtcaagagtttgagaccagcctggccaacatggtgaaaccccgtctctactaaaaagacaaaaattagccaggtgtgatggtaggcgcctgtaataccagctactggggaagctgaggcaggagaatcacttgaacctaggaggcggaggttacagtgagccaagatcacaccactgcactccaacctgggtgaaaggcaaaaatccgtctcaaaaaaaaaaaaagtttcaaagataaaacaaaaatcttgttaaagataaatacacgagatgctaaagaaataatctacttcttcaagtcatgctatcaatttgcaccaaaattttcatttcctatgtgtaggtgttgagggtcttgtacccatgataaatgacatacacctgttctgggctgacttttgttccccaaaagagatatatagtactccaaggggctgggcacagtggcacatgcctgtaatcccagcactttggaaggtcaaggccacagcatcgcttgagctcaggaattcaatatcagcctgggcaacatggcaagaccccggctctactaaaaatataaaaaaatagccaggtgtggcagtgcacacctgtagtcccagctacccgggaagctgagatgggaggattgcttgagcctggggtttagggggctggaggttgcagtgatccaagtgccactgcactctagcctggatgacagagggagaccctgtctcaaaaaaaaaaaaaaaaaaaaagatatgtagtactcctaacattcagcacctcagaacctgatcttagagacaggatcttcaggccaggtggcttcccttcctctccgcgtcagtctgtcccacctcagctcagcccaccggagacagagggtgcaggaacctggaggcggaggttgcaggaagccgagatcctgcaactgcactccagcctgggcgacacagcaagactccgtctcaaaaaaaaaaaaaaaaccttacaacaaaatgatgcagcccgggcgcagtggctcacgcctgtaatcccagcactttgggaggccgagtggggcggatcatttgaggtcaggagttcgagaccagcctggccaacatggtgaaatcctatctcaactaaaaaaaaaccaaaaactacagaaattagccaggcgtgatggcgcatgcctgcagtctcagctgcttgggaggctgaggcaggagaattgcttgaacccgggagtcggaggttgcagtgagccaagattgcgccgattgcactccagcctgagtgacaagagcaaaactccatctcaaaaaaaaaagaaaatgcaaagtcacctaagagacagtttaaatacataaaaagctcgatgccaaataaaactggatgggtcacttgataagtgggattgataaaaagcaagacagctgatattatataattcttatttgcttcgatatttactggggaaggtagaggggaaaagctatctaaattactcttaataagcatacaaatctctaatagtgaatcaaatgcatcattaaatatactaaattcctcaaactgatatgtcagatgtcaggtagtcatgaagacccaaaatagtctccatgggttttttgttgttgtttttttgagacagagtctcactctgttgcccaggctggagtgcagtggcaccatctcgactcactgcaacctctgtctcccgggttcaagccattctcccacctcagcctcccaagtagctgggattacaggcatgtgccaccacatttggctgatttttgtatttttagtagagacagggtttcactatgttacccaggctgttctcaaactcctgacctcaagtgattcacccaactcggcctcccaaagtgctgggatttcaggtgtgagccaccacgaccagccccttctctgtgttttaaaggcatttaagtataaattattaaactgcaggacagaacatattagctgacggtcatatgagtgaccttctctaaatgccaggaggatagaatccacttttcctttatcaatattttccttgctcaacttctgacatattaggtactcaataagtatgtgctgaaccaaaacgaacaaaaaaatgctgtcatcaaagtaacttccatctactcaagtaggctgcaacttcaaactgcccaaactagcaaatctctaataaagatgggctcagaagacatatcagcatgaataaccttctgaggaaaagacaacatggattctaaaagtggacatcacaccacaccagttcacccaaattctctgagaaaataaatatgtgtggctgggtgacggtggctcatgcctgtaatcccagcactttgggaggctgaggcgggtggatcatgaggtcaggagatcgagaccatcctagccaacatggtgaaaccccaactctactaaaaatacaaaaattagctgggtgtggtggtgagcacctgtagtcatagctactcgggaggctgaggcaggagaaacgcttgaacccgggaggcggaggttgtagtgagccgagatcgcaccactgcactccagcctgggcaacagagtgagactctgtctcaaaaaaaaaaaaaaaaaaaaaaaaaaaaaagacctgagtggccacaggatgagaacatttactgtagactggacataactgagacacagaaaattataggtagatgctgaggtacttccccaaatgaagaagtaaaaacagaagattgaaaatttttttagaaatgctatatttaacattttaatatattgtacaaaaaatatacagagaattccccattttgcagatgggatgatgagattcctaataatgaaataccacacgagttggaaaaataagggaacggagtgatggaaagggtttctaaatatattaaatgagaaacatttgcaaaaactaagatttatattcagcttagagaatgctttggcaagtataaaagctgtctaaatatgtgaagggttatctagcagaagacaaaccagacttgctctaagcagttcccgtgtagacaaaattgggcccaaagtggcaattccagaagggcacgcttcaactcaagctttctaaccatcagacctaactaaaaaggtggttcttaccttggattacctctaagagcccactgagatatgagtgttaaaaaattacatgcgaggaaatggcaggtatgttacagcatggacaaatgaaaagtaaggcatttacaggaaaaaaaatctaagctatacttaaaagactcatgccttcaagtcaaaaaaggaatttttgaataattatagaatattccctaaagacaatgtgatgttctatgcaaaaaaaaaaaaaaaaaaagggagggagggaggaccaaatcctattaggaaaaaactgtaaatcaagggtacccaatcgtttggcttccctgagccacactggaagaagagctgtcttgggccacacataaaatacactaaagtaacaatagctgatgagctaaaaaagaaaatcttaaaaaaaatctcataatgttttaagaaagtttacagatttgtgttgggccacattcaaagctgtcctgggccgcatgcagcctgtgggccatgggtcggacaagcttgctgtaaatagaacatattttcttatccttctaccaaatcacagtgtagttataactaaaatgcagttctgagtagttatcataaatccagaaagggaaagcaatgctgacaaagatcctggaaggaggtttcactggagattaaattaaaaagtcaagcatcttcagttgagaaacatgaaagcaaaggggcaatgtgatcaaaatcagaaaacgtatcaatatggtaaatactaatttattcaccttttatgcttgaaaagtatttctttatataacagataaaagaaacttgtggattgtgttaccacaatctacaagttaaaaatagattcaagtgctcggataaatgtaggtatattaggtccattcaggtcctacaggatagaagtgctatcagacgtgaggccctaaatttctgaggttaacatcttaacagataacaatgtttcacctgaaaacatcacttggtgccaatttagacagaacaattggttggacagaccccggacagacagactcaaggaggctggttggtatagacttccttccattcttttacctcagtatgtatgtgtgtgtaatatatacatacatattatactagaacatatatacattccttatctttatacacttagaatgctccttatatagctctgcaccctgaatttttcatttatcatttactcaacatcctaagacattaaaaattctttttttttttttagacagagacttgctctgtcaacaggctggagtgcagtggcaccatctcagctcactgcaacctccaactccctggtccaagcaattctcctgcctcagcctcctgagtagctgggatttcaggcacgtgccaccacgcccagctaatttttgtatttttagtagagatggggtttcaccatgttggccaggatggtctcgatctcctgacctcataatccgcccacctcggcctcctgaagtgctggaattacgggcatgagccaccgcacccggccagaaaaattctttcaaatactattccatggttgtaaatgtccatccttaaatataccatgatttattttcctataaatcttgctgctcatttaggtttattctcaattctcactaatatgaataatgttacaatgaacatctttgttcacaaatctttctatgtatcttaatttttcccctttaggataaattcctagatgtgcaattactgaattaaagaacgtttttaattttgccaatatatgttgccaaaatatctttcaaaaaaactaggcccaatgcacactccactagcagtttcagagattgtcccctcaccaccttcgacagcacagtcaactgtaaatctgataggttaaaaaaagagtatgtcatttaatctgcattcctttgattacttatcaggataaaaatgtttctcatatgcttcttggtcatttgtatttcttccttatgaactctgatcatgttctttgccagcaaaacttttctttctcttggccgacaaactttctgtggaaaaccagctgagatggaatcatttaaatatcagcaactgcagctccccctgctgacagataaattaccaccaccatcaagtgcccagtaaaaaaaagtgagctagaaccatacgcttgcctgtcttctgggctgctgctacaaatacaaattatacacggtaataaaaaagaaaatactgtgtatctaaactcatacttaacagagctgtgatggagaaggcaagggggacaagcgttttatttgttttttgttgttgttgttgttgttgttgttttttgagacggagtctcgctctgtggcccaggctggagagtagtggcgtgatctcagctcactgcaagctccgcctgctgggttcacaccattctcctgccacagcctcccgagtagctgggactacaggcacccaacaccacgcccggctaattttttttttttttttttttttagtagagacggggtttcaccatgttagccaggatggtcttgatctcctgacctcatgatgggcccgcctcggcctcccaaagtgctgggattacaggcgtgagccaccgtgcccggcccaaacgttttctaatgtgcaggaactaggcggggtgcagtggctcacacctgtaatcccagtactttgtggaggccgaggtgggtggatcacctgaggtcaggagttcaagaccagcctggccaacatggtgaaaccctgtctctactaaaaatataacaatcagccgggtgtggtggcacgtgcctgtagtccgagatactcaggaggctgaggaacgaggattgcttgaacccaggaggtggaggttgcagtgagccgagactgcgccactgcactccagcctgggcaacagagtgagactccatttaaaaaaaaaaaaactaatatgcaagaactaatgtcacaaacaattctaaaaatcaattccctgccaaatatactacctggcacatataaacatcacagacctaaatattcatttccctatactttaactatgtgaaaacactctaaattaccaaatgacactgggtggtcagcaaactagttctctttttccaaaagcaaaaacaacaaaaacacttttgccctttagcattcaaagaaagagtattaaaaatcttaattcttggcaatccttattccaaagttgcttgcacttatcagactgggaccaatagatccaaagagtaaggccaagactggcaaatgcatgtgactctcagcttttccactgataccctcctaaagatgcatgtcccaagtccagcaatacagtctttaacactcatttactaagtgccatcaagagcaagcagtgatggccgggtatggtggctcacgcctgtaatgccagcactttgggaggctgaggggggtggatcacctgaggtcaggagttcgcaaccagcctgaccaacatggtgacaccctgtctctactaaaaatacaaaaattagctgggcgtggtggcaggcacctgtaatcccagctatttgggaggctgaggcaggagaatcacttcaacctgggaggcagaggttgcagtgagccgagatcgcgccgttgcgctccagcctgggcaacaaagagcgaaattccgtctcaaaaaaaaaagaaacaaaaacagcaagcagtgaggataaaagacaagagcaagtcctcactctcaaagaacctagacactagctgggttcaaagtggagcaaactagcaatcagtacaatagaagtgctaggtctgcatatgcacactcacatgcacacacactaacagtttcagagattgtccccttaccacctttgacagcacagtcaactgcaaatctgataggtaaaaaatagtatgtcatttaatctgcattcctttgattatttatcagaataaaaatgtttctcatatgcttcttggtcatttgtatttctttatgaactctgatcataaagtgataatacctgggtccagaggaagcactcagtgtcagctactgttattactattatcactactgttattttgttttaaggctaatcaagtgaagcagtgggagtggagaaggaacaaagaaatctgtaactggctgtgatcaattaatagtaaacaccaatatacttggaccagccactactgttattaaagactagggggagtaagtttccagaacagggtagagtccatcttaagcagaggtaactgcttgtgtgaagacccagaggcaaagaacaacagggttcacagaaggaactgggcacaagctatctgtactactgcgtacaggatgctcaggaagaagtggagagatgatctggcaaaacatttcaactctaccttcaaagctagttgagccatggtggaagagggagggatatgatcatacgcttgaacatgcattttacaaggatcatgttggcagcgacttggaagagagaaagcagtcaaggagaatgattacaagacaacagaaggtcacgcagccaaaagggcgatgaaggtctggactcaaaaaggagaagtaggatgactaggaaaatattatgagctaggatctcaagaatgtggtgactagaatggcacaagaaggaacccagaggcctctcaaatccctgatttgagtgactggctgggtgacactaccgctcactaagatacgaagataggaagaggttggactggggaagtggataagatcattttaaaatgcccataagatggccagatgcagtggctcacgcctgtaatcccagcactttgggaggctgaggcaggtggatcacctgaggtcaggagttcaagcccagcctggccaacatggtgaaaccccatctctactaaaaatacaaaaactggccggacgtggtggcgcacacctgtaatcccagctacccggaggctgaggcaagagagtcgctggaacctgggaggcagaggctgccgtgagccgagaccgtgccactgcactccagcctgggggatagagcgagactccgtctcaatagtaataataataataaaaaaataaaataaaatgcccataggacatccaagtagagatgtccaggaagcaactgtgtatatgggattggagatcagaaaactagtcagagctggaaaaacacacatttgcaaatcatcggcatatagacggcaagtgaggcacaagtttatctaaggcattcctcataaactgcacagggtgagaggaagaagggtcaagggaaggcaaatactaatgtttttaggagcaaaagaggaaaaaagtctgcaaagaaaaccaagagtatgggccagacttggtgactcacacactttgggaggccgaggcaggtggatcacctgagatcaggagttcgagaccagcctggccaacatggtgaaacccatctctactaaaactacaaaaattagccagatgtggtggcgggcacctgtaatcccagctactggggaaactgaggcaggagaattgcttgaacccaggagacggaggttgcagtgagccgagatcacgccactgcactccagcctgggcaaaagagcaagactccgtctcaaaaaaaaaaaaaaaaaagtttcaaagataaaacaaaaatcttgttaaagataaatacatgagaagctaaataaataatctacttctttaagtcatgctatcaatttgcaccaaaattttcatttcctatgtgtaggtgtcgagggtctagtacccatgataaatgatatacacctgttctgggctgaattgtgttccccaaaagagatatgtagtactccaggggcctgggcacagtggcgcattcctgtaatcctagcactttgggaggccaaggccacaggatcgcttgagctcaggagttcaatatcagcctgggcaacatggcaagaccccatctctactaaaaatatttaaaaatagccagatgtggtagtgtgcacctgtagtcccagctactcaggaagctgaggtgggaggattacttgagtccaggggttagggggctggaggttgcagtgatccaagtgccactgcactccagcctgaatgacaaagggagaccctgtctcaaaaaaaaaaaaaaaaaaaaagagatatgtagtactcctaacattcagtacctcagaatgtgatcttagagacgggatcttcagaccaggtgcagtggctcacgcctgcaatctcagcactttaagaggccgaggtgggtggaccacttgaggtcaggagttcgagaccagcctggccaatgtggtgaaaccccatctctaccaaaaatgtaaaaattagctaggcacggtggcgagcacctgtaactccagctacttggaaggctaaggcagaagaatcacttgaacctaggaggaggaggttgcagtaagctgagatcaccccactgtactccagcctgggcaacaaagagagactctaaaaaaaaaaaaagagataggatcttcaaagaggtcataaagttaaaatgaggtcatcagagaggactctaatcccaatatgacttgtccttataaaaaaggggaaattgtggacacaaagaaatacacacagggaggctgggcgccgtggctcacgcctgtaatcccagcactttgggaggctgaggtgggcagatcacttaaggtcaggagtttgagaccagcctgggcaacaaggtgcagccctgtctctacaaaaaatacaaaatttaggctgggtgctgtggctcatgcctgtaatcccagcactttgggaggccaaggcaggcagatcacctgaggtcaggagttcaagaccggcctgggcaacatggtgaaaccctgtttctacaaaaaatacaaaaaattacctgggcatggtgacacgtgactgtaatcccagctacttaggaggctaaggaaggagaatcacctgaacctgagaggcagaggttgcagtgaaccgatattatgccactgcactccagcctgggcaacagagcaagactctgtctaaaaaaacaaaagaaatacacacagggagaactctacataaggactggagttatgctgccaccagaagctagaagagaggcttgaaacagatcctgtcccagttgcttcagagaaagcatgcctctgcccttagatttctagcctccagaacagggagacaataaatttctgttatttaagccactcagcatatgtcactctgtggcagcagccttagcaaacagatgtcataagaaaattcgcagctcaggtttactaagtacctaccaggtgctgttctaaacactctgcgtgaataaactcatttaatccttataaagtccactctaggatctaggtactatcattataccctttttacagtgtggacaccaaggttctaagaggttaatgagcttacccagtatcacatagccagagccctctctctcaccactagtgtatgaggagctattattaacagtaattacaataagagctggcgtggtggctcacgcctgtaatcccagcactttgggaggccaaggcgggtggatcacttgaggccaggagtttgagaccagcctggccaacatagtgaaaccccgtctctactaaaaatagaaaaataagccgggcatgctggcatgcgcctgtaatcccagctacttgagaggctgaggcaggagaattgcttgaactcaggagacacaggttgcagtgagccgagatcgtgccactgaactccagcctgggcgacacagcaagactccatctcaaaaaaaaaaaaaattagtaattacaataagaacagtagtagtccactgaaccaaacactgccctatgtcctttacagatataatacaaaagtcctctgaagtaagtgttattatttccagtatgaaggaggaacctgaatctcagagagattaagaaaatcgcccaaagtcacacggttaagagtgctgagattaggccgggcacggtggctcatgcctgtaatcccagcactttgggaggccgaggcgggtggatcacctgaggtcaggagtttaagaccagcctggccaagctggtgaaaccccatctctactaaaaataaaaaaaaaattagctggccatggtgacaggtgcctgtaatcccagctacttgggaggctgaggcaggagaatcacttgaacccaggaagtggaggttgcagtgagccaagatcacctggacaacaaagcgagactcttgtctcataaaaaaaaaaaaaggaagaagaatgctgagattatatctaattgctaacttaaggggatatacaatgaaaacctgtttttactaaaactttaagaacaagttaattttttttttttctttaatgagacaagagacaaggtctggctctatcacccaggctggactgcaggggcgcaatcacagttcactgcaacctccacctcccaggctcgagccatcctcccacctaggcctctcaagtagctgcaactacaggtgcacaccaccatgcctggctaattttcttttgtatttttagtagagatggggttttgccatgttgcccaggctgttctcaaactcgtgtgctccagcgatctgcctgttcagcctcctaaagtgctaggattacaggcgtgagccatcgcgtctggccaagttaaattttttaatgcctgactttgcagttcaatactagaaatatacatctataaattcaaaattcttgaagatcccaagagaacacatgtcctagattatgggcccttttgcgtgtgtatcccctcaaccactgttcaagaactattctctcggctgggcacggtggcccacgcctgtaatcccagcactttgggaggccgagttgggcggatcatgaggtcaggagatcgagaccatcctggctaacacggtgaaactccgtctctactaaaaatacaaaaaattagccgggcgtggtggcgggcgcctgtggtcccagctactcgggaggctgaggcaggagaatgacatgaacccaggaggcacagtttgcagtgagccgagattgcgccactgcactctagcctaggtgacagagtgaggctccgtctcaaaaaaacaaaaacaaaaacaaaaaaactattctctcagttagaacccttgccatttctctgacttccagacacagaaagagaagaaaaggaaggattgagatgctgttctttaaaatttttttttttttttgagacggagtctccctctgtcgcccagactggagtgcagtggcacgatctcggctcactgtaaactccgcctcccgggttcacgccattctcctgcctcagcctcccaagtagctgcaactacaggcgcctgccaccacgcccagctatttttttgtatttttagtagagacggggtttcaccgtgttagccaggatggtctcgatctcctgacctcatgatccgcccgcctcggcctcccaaagtgctgggattacaggcgtgagccactgcgcccagctaaaattttcaattttctatttaatttttaaaatctgatacaaacatcagaaagtgtaaaaagatataatgcaatgagaagtctccttcctactctgtcctctacctgaacaattcctagacctaacaggtaaccagtgccaccattttcttatttattcttctaaaggtttgtgttgttgctgttgtttgagacagagtctcgcttggtcagccaggctggaggacagcggcgtgatctcagctcactgcaagctccgtctcccgggctcaagcaattctcctgcctcagcctcccaagtagctgggattacaggtgtgtgccaccatgccccagctagtttttatattttcagtagagacggggtttcaccatattggccaggctggtctcagactcctgacctcaggtaatccacccaccttggactcccaaagtgctgggattacacgtgtgagccaccatgcccagccctaaagatcttttttttttttttttgcatacatacaccaatgcaaattatctttttctcctgtttttttttttccaaaaaacacaaagggtatcaaatcatacatactgttctgcatcttgctttcatcacttaactgtctgccttgcagatctttctatatcatattaaattatgttttaattctctcgttttgcttgtcaagaacagtttttacttcatttcaccatagttcagtctagcacacaaggcatccagcagccctaagaactacctgaaacaactgatgatggctccatgctacacactaaagaccctgtatcttttctctcctcctcatcttcatttcactcttttctccgactcactcaattctccttcctttccctattcctctcccatctcacccactccttagccctaaccctgacaactagaccctagtaacatcactgacattgcttagtcgtggctagaaatattcaggctttaaaaaggtacagacccctaacacagagaaaaagggataaataataatttccatgagaacttctaattaacgagagtgccttaaattgaggagttttggcttggagttattcttccttgttacttgcctcctctggcattttcatttgtgaagactgagtgagtgtgacgctattttctatacgcatggaaacaagcacatactcagtctaacatttacgcaatgcctgacagaacgacagagttcattctacaataagataattggaaacaaaatataagatctatataaaataaacatttgggctccaaaatatgcactttaattaacctatcatttctttttacttaaattaagtagctccaatctgaaactacatcttagaaatgttttaaggatattcaccaatgaaaaagagaataaagttccctctccccacttttattttccagcccacaaactcaatgctatcctccccgcaaaaaggacctttttttctgaccagacgaacactgtaatttttaaggtttctaagtaataaaaataggaagaaaacattaccccccaaaattggtttacacttagaagatgtttcccactgagcaaaggattggtaaggaacataatattaaggcaaccacctaactgcattcttaagtagtaacaggtggtaactcacgatatggagctgatttcctttctctattcctgccatgccagagacctctagtagaacttctgaggttactgtattacaacccaggttcagagagatttagaggtaaaaccttaaacactggaaatatctttaaaagtagggctttgtgtaccaaatacattcgttaaaacctaggaaactataaaatgaaatccaatgtattgatctcaatccccttgcctgcttcctaaagaggacagaggccaccaacactggtgctcaacacttgctaagtcgaaacactcttacacaggtcctctgattcttaacgggttcagaacttctggttgcattccccatgcaacccctccaactctacagggagaatgctggaaaaactgtgtcactttggcttcctgtatattaatataagcactcttatccagcaatagcagctgaaacataaatgaagatgagaactcagcctacatgacctaagatttcccacaagtccagatatttaggttacacacactgcactattgtctgatttctcctctgcatcaatctggaagtccacagagcagattagcacccaacaatcttaactaagctagtatcctactctgaagaaaggcgaagctggtggagggtttccaagactccttatccttctctgtccttcctcccatcccctccttacgtcttttctgtttgtttttatttaattttttttttaatgtatttttagtcacaagaaaatcaaagaagccacctacttaagtcttaagctctgccctttgcttagtcctaatggagagttctttggccatctatgtacaagagattagaggagccaaagagactggagaaccacatcaatgggagctttttcatctaaaggtcatctgtccacactgtccaaatgaggtttaccctgtgaaataaaacttggtgtaagtgctacctgctgagaaaaatagtatgaaatgtcacacaaaggactggggtgcagcaggaggactctgaaagagtcatacgtgtaaaccagcaggtcttagaatgccctaatatactatatgaagtttcagagtaaacaaatggttaatgacacatcttttgtaacacatgaatcagctactgatttgcaagagtgggacacaccctagtacctatgactctaaagtacctgtttgaaaagtggacctagatgtttgaattgccaacccatcctaagaccggaacataattttacaactatgtaagttgccataatttaaagttaaaaagatcactgcctttcattataatggaagttaatttgagaacttcattaaaacattcacaccgataatcaaagaacagtagagatacaaagtaaaatatagccaatcaatcctaggaagcaaacacaagaggcaagagaaatggcaggtaaaggaagtgaagaatagcaaattcaaaaactacaatattcccaattctaaagaaaaatgaataaaatgaggctggtaatgaaaaaataacacatcttaccttaagaggcatccaagtagcattcatagtgtcaggatataaagacaatactcagaaatgagcaagaagtcttagtaattccctcggttaccaagtataagcaggtaggaaaatcttttgtttcgagaaggtatctgaaagagaggattttcatttagactaaaaaataatcaagacaatgcaaatagtttaagctacctgggcagggattttgaagtactatttgcctcatcgcactaaaaaagtatagaaaatacagtcccctttagaaaagggcaaatgtgtgtctccatatatatgtgtgtagaaacatactttacataaaaagagaaataaatatgtaacacgtattttagataatgtaaaattgcttatcaaacaattagccaaaatcccagagagaataaagtaattttccagggtacttcataaacactaaacgtgatttgttaactaaccgtctaaagaaagacccttgccacatttaattatatttagtaaagtaaaacttctctaatcatcccgactgtcccaagattatgcttaagtttcagagtcaattccacatgaaaagtaaaacctattcttgactgaagtactagaaacaaataaaagacccttcttccccagagatcgttaaaagcagaccgagcaacttaattttgagggtgggaggaaggtaaatttgcctggaggcaggaggatggactaaatgacctctggtaggatcctcgttcaagtcctgggcctgtatacaattccagcttaaccagttactgcttcgcttaaaatggaggcttgcctgcgtagggacaaaaataacagcacccacttcttaaaaataaatgtcgaaaagtacccctttttaaataaaaataaaaaataaacacctctggagtggatgtgttcttgctatgcgtttgtcactgaggcttcgaagacttggcatcactttccttaccgctcaccggattttgggggaggagcggggggcgacagtttgactcttgacccaagtctcaggcggacttcagagccccacaggggcccccaactccagagccagagggagcggagaggcgagagcccgagatcgcacctccccccaccgcggaccccagtcccaaacccacccctcacctccccgcagtggggcgcctccttctgccccattcccattgttagggagggcagagcgcggggtgggctcagggcaggggcgcccgcggccgttgcccggctcgcttcaggaggggcgccccgcgggatgcggcttcccttcctctccgcgtcggtccgtcccacctcggctcggcctggcgccccgaggtccgctccgcgcccccggccgcggccccggcccgccccccgggcagccaggccctcaggccagtcggccggcagccggcgtcccaggcctacgagtgggcgctgggcgggggtccccgtgccccacacacgcgtcccctctcccccagccccgccgcttccagggccctcggcggcgcccgctccccgggccccgcggccccccgcctcccagccgggccgctccctcgagctcgtcgggtcagggacacctcctctacctcaccatcaccctggcccactcgtgcccccacccccaggggcaccagtgccaaaggcagctcccccagccccggacctacctgcacggttcaaccaagcctagaagtgggggcggggaatcttccgccctcctctggcgcccattggcccttcaggggcacatcgtgagcgccattggctgagcaatggtgtccgtcagagcgatggggcgggacagaagggggagagggatgctggtgccttggcgtctctgtctctgtgtatctcgttgtctctgtctctgtctcggcccttggaaacgagaggcttttggctgagaggactagaagggggcctgaggtgggaggaataggaataggaatcctgacagagcgtcacgccagttggccactctgaacgccctacctaagtcccctttaggttctcttctccatcacccccaacccctgcccctcacccctcgaggttctttcatccaggaagcgacgtgatgaaaactccaggccggaaggccatagggagagatgttatatatgtatataaaatatacacataaaaatgtttatatataaactcaaccagatatcagttcactagggcctggaaaggaaagggcacacatctcacagacagggaaggacttgagatagagccggtagaagaaggaatcaaaaatcactctaagagctggcaacagtggttacctcctgggagaggaactgagtgcctagggaaccagtgggcggaagacttacatatctcggcatatcatttgtatccattgatttttgcaccattcatcaagattccaatttaaagaaaaggatttaaatgtttaaataaggtcgcaaaaccaggggacagacaagataattgggcaggaaaattggcgcaacatgcagatttggggaggaatcttagcttttaatatgttcagctcccggtaacagggttttgtaaaacccagtgaaggtgtcccagaggcaactgaagttatggaacttgagagagggtagacaatcaggactagagaagatgcagggtcctctgcctaaagatagtgatctatgacatgctaaaggataaactcccaaagaagggtaataagacacccacagtaaaaggtaggaggacgaaaaagaaggtcagtgaggtaaaagaaacaatattaaagaggcatgaaaattaagggaggaagggtctgtggaaaatagaataataaaactatgagagaggccgggcacggtggctcacacctgtaatcccagcactttgggaggccaaggcgggtggatcacctgaggtcaggagttcgagaccagcctgcgcagcatggtgaaacccgatctctaatagaaatgcaaaaaaaaaattagccaagcgtggtggcgcgcctctgtaatcccagctactggaaaggctgaggtgggagaattgcttgaaccgggaggcggaggctgcagtgagccaagatcgcgccactgcactccagcctgggcgacacagtgagaccctgtttcaaaaaaaaaaaaaaaaaaaaaaaaacaacaaacaaactgtgagagcctcataggtcttacctctttacctctttaggctctggtaaccatgggacaataagaatgaaagccaaggccgggcacggtggctcacgcctgtaatcccagcattttgggaggccaaggtgggcggatcacaaggtcaggagatcaagaccatcctggccaacatggtgaaaccacgggcatggtggcgcatgcctgtaatcccagctactcgggaggctgaggcaggagaattgcttgaaccagggagtcagaggttccagtgagccgatatcacgccactgcactccagcctggatgacagagtgagactccgactcaaaaaaaaaaaaaaaaaaaaaaaaaacaacacctttatcgattaagaatcttttttctgagtttattaattctatttaaatcaaccccagaaaacaccttcaacacagcctctcatttcatatctgtaaaatggggcaaaaaaaaaaatagttcctaccctttagagttgttgtgaagattaaattagtgaatacatatgatggatttttttttcttttttcttttttatgagacacagtctcgctctgtctcccaggctggagtgcagtggcactatctcagctcactgcaagctccgccttccgggttcacgccattctcctgcctcagcctcctgagtagctgggactacaggcgtccgccagcatgcccgactaattttttgttatttttagtagatacggggtttcaccgtgttagccaggatggtctcaatctcctgacctcgtgatccgcccgacttggcctcccaagtgctgggattacaggcatgagccatggcgcccggcctgtgtgatggattttttaagagcctgactggcggggtgaggtggctcatgactgtaatcgcagcactttgagaggctgaggcaggtgaatcacttgaagccaggagttcgagaccagcctgggcaacatggcgagacctcgtctctacaaaaacacacacacaaaaattagctgggtatgatggtgcatgcctgtagtcccagctactcaggagactgaggtgagggtcgcttgagcctgggaggcagaggttgcagtcagccgagatctcaccactgcatttcagcctgggtgacagtgtaagaacctgtcaaaacaacaacaacaaaaaaaacaaaacaacaacaacaaaaaaacgcacgaaaaaaaccacataagctccttgagggcagaaactgtcccctagtcttctatattttatttcacacaatgtacagaagactaaatgaataattgttagctggtttttttttttaaaggggataagatcagttacaatgtctttttcctcagtcaatcacataagtatctaaaatgacattccaaagtaaggacaggagtttaaatcctgaactatggtatctaaagtaaacttgaactttccttatttttaaaaaattttggccgggcgcggtggctcacgcctgtaatcccagcactttgggaagctgaggcgggcagatcacaaggtcaagagatctagaccatccttgccaacatggtgaaaccccatctccactaaaaatacaaaaattagctgggcgtggtggcacggacctgtagtcctagctacttgggaggctgaggcaggagaaccgcttgaacccgggaggaggagactgcagtgagccgagatcacgccactgcactccagactggcgacagactgtctcaaaaaaaaaaaaaaaagaaaaagaaaaaagaaaagaaaaaaattccatacatagaattctgtgtggcattttagagaaaatcatggtgactagagacaccaggtgaaatttttttttttttttttttggtgacacaaccccaggagatcctgtgaacatgtgtcccttgaccaggtgaatttcaggagcttgcactagtcccaggttagctggcaccaggttggccctagtttgagtgccttccacataccaggtactgtgctggagaagtaacatcaaaaaggaaaatcaaatttcatcttcaataagcaatcacaatacactgtgatgagagttagggtgaaggaggttcaggttaccatgggcttatattaggagggcaaattctgtcttcaagtctttttgcttcaacagtagcgtttagatcttgtgggctgggcatggtggctctagcctgaaatcccagcactttgggagggtgaagtgggcagactgcttgagcccaggagttgcagattagcctggcaacatggcgaaaccccgtctctacaaaaaatacaaaagtcagccaggcatagtggtgcctgcctgtagtttcagctacttgggaggctgaggtaggaggatcgcttgaccccaggagttcaaggctgcagtgagctaccatcgagccacttcacttcagcctgggccgcagaataagaccctgtctgaaaaaaaaaatcttgtgatataataacagcttgtgcactcttcgatagctcagctggtagagcagagggctgtagactgcatagataataataacagtttgcgtttttgagtcaaagatgataccccagaatcattatcgaaaataatggttgatccattcacctgtgcctatgactgtgagccacattgtgaccaatctgtgagcaacatgggtgggaatgcagtttggggccatggaactcacttaacaggaagttccaatagcagtggatttaccatgttgcggctgtaggatcttggacaaatatttaatgacctctgtctctcagttctctcaataataaaacatccctccgagagttgctgtaaaggttaacatagggggagtcttgcaaatagtaggtgctaaaatcctgtcttgaaaaaaaaaaaaaaatatatatatatatatatatatatatatatatatgaagagatgagatcttcaattgtacagactgtccctgtacccattcatttgcatttcttttcctttacaataatacatatctatgatttcctttcattcccactgtcatcaatttagttagattactgggcagagatcaccagtggggctagagtaaaatgaaaataaatgtacattgactctaggtattcctaagtaatagcacagtttactgtgttctccctcataaatcctggtagctgaatgttgcctgcttttagcagttacgtttctgctcatctcaccctcaatgttcattaagaaaatagttattgaatggccaggctcactggctcacgcctgtaatctattacaggcgtgagccaccgtacccagccttggttatcatatttctaatttataatagtttttcttgttttcttattgttcattttttatagcatcctgttcttatattatggatatatatcttcaggtctcgctgaagaaataaagaggtgtatgtgtatatatgtgtgtgtgtattatctttatttttattttttgagatggaatcttactctgtcgcccaggctgtagtgcagtggcgcttttgggaggctgaggtggaaggatcacttaaggccaatatttggagaccagccagggcaacataacaagacccccatctctacaaaaaaattaaaaattagctggccatggtggtgagtgcctgtagtctcagctacttgggaggctgaggcaggaggattgcttgagcccaggaggttgaggggggaggtgagccatgattgagccactgcactccagcctaggtgacagagtgagaccccatctctaaaaaaaaagagagagagaaataaaatagttattgagcacctactgtatgtcaggtccaagaccctaaagatgtaaagatgaataaggtggtgaccctgccttccagtttccacaaaggtggggaatatggataaaagcagacaaagccattgccatgggataagggcagagaatagcatgtgcaaattatagaaggtgagggataatataccactttccagaaactgatggttcaatgaggctaaagcatggagttcaagaaaggaaaccagatgagattaactgcaatgtggttctcaaacttaaatgtgcataaaaactggccttgttgactgggcacagtgactcacaccggtaatccaagcactttgggaggtcgaggcgggcggatcgcttgaggtcaggagttcgaaactagcctggccaatgtggtgaaaccccatttctttttttttctttttcttttttttttttttttttttttgagacagagtctcgctgtcgtccaggctggagtgcagtggcgtgatctcggctcaccgcaagctccgcctcctgggttcacgccattctcctacctcagcctcccgagtagctgggactacaggcacccgctaccatgcccggctaatttttttgtatttttagtagagacggggtttcaccatgttagccaggatggtctcgatctcctgacctcgtgatccgtccgccttggcctcccaaagtgctgggattacaggcgtgagccaccgcgcccggcctgaaaccccatttctactaaaaatgcaaaaattagctgggtgtggtggtgcacacctatagtcccagctgctcaggaggttgaggcgggagaatcacttcaacctgggaggtggagatggagtaagccaagatcaagccactgcactccagcctgagtgacacagcgagactctgtctccaaaaaacaaacaaacgaacaaaaaactggccttgtttacatagtctcgcaagctccaagcctagagatcttgatggagcgggtcagagtgctgctgctcggagggctacactctgagaaccaccgatggagaagaagggcggggtcaacttgcagagctgtgctgggaggtgtgtgctgcagccttgagggggtgaagaacctttgagaggttttaagcctgcaagagatgtggtcacatttatattttagaaaaatcaccctgtgtgcaatatgaaaaatgaaacagagagggcaagactggagtcagggagagcagttaggaggctgctgcagaaacccaggcaagaaatcataaagacctgaaataaaacaatgccagtggggaacggggaagagaggccaaatccaaggggtatttaggagccagaattgagagggtgtgatgagtgttgatgggatacaggacaggatcctgagatggcttgcaggtcttcagctttgagtgacccatggaagcgaaggaagatgggaaggagggtgcctatcacacagagagaatgaaggtttgagaggcaagtgtagcttttgacattttgcttttgaaatgtctatgggacatcagaaataatctcaaaagaccacaagtcaggcagggcgcggtggctcacgcttgtaattccagcactttgggaggccgaggtgggcagatcacgaagtcaggagctcaagaccagcctggccaacatggtgaaaccccgtctctactaaaaattcaaaaattagctgggcatggtggcgggcacctgtaatcccagctacttgggaggctgaggcaggagaatcacttgaacctgggaggcggaggttgcaatgagctgggatcgagccatcgcactccagcctgggcaacaagagtaaaactctgcctaaaaaaaaaaaaaaaccatgagtcactggttaacagcctgagcggcagaaatctcacagttctgagtctgaatcctatctagcctggctctgaaactcacaatctggagctggggcttggtgcagtggctcaggcctgtaatcccagcactgtgggaggctgaggcaggtggattgcttgaggccaggagtttgagagcagcctggccaacatggtgaaaccccatctctactaaaaatacagttagccaggcatgatggtgtgcacctgtaatcccagctacttgggaggctgaggcacgacaatcgctggagcccaggaggcagacgttgcagtgagccgagattgtgctactgcactccagcctgggcaacacagcaacactgtctaaaaaaaaaaaaaaaaatgctgggcgcggtggtttacgtctgtaatcccacttttagaggctgaggtgggaggatcacctgaagccaggagctcaagaccagcctggccaacatggtaaaacccgccatcccctccctgccatgccccatctcccccaacactctcccaccctgtctctactaaaaatacaaaaattagccgggtgtggtggcacacacctataatctcagctacatgggaggctgaggcataagaattgcttgagcccggaaggtggaggttgcagtgagccaagatcgcaccactgcactccagcctgggtgacagagcaagactctctcttaaaaaaaaaaaaaaaaagaattttttttttaaatatagagatgggctttctgtgtttcccaggctatactcaagctcctgggctcaagctattctcctgcctctgccttcaaccagcctcaatcctccaattttcttattttttatatttttcaacaccttttaaattctacattctggccagctgcagtggctcatgcctataatccagcactttgagaggttgagatatgagacttgcttgaggccaggagtttgaggcttgcagtaagctagaatggcgccacggcacagcagcttgggagacagagcaagaccttgtctcaaaagaaaaagaatttaaatactacattctaggagatttcttcaaccttcaaattttgtattgaatttttaattttggcttttatttatttattttttttttgagacaggttctcactctgtcacccaggttggaatgcggtggcttgatctcagctcactgcaacctctgcctcctgggttcaagtgattctcctgcctcagcctcctgagtagctgggattgcaggcgtggtccagcatgcccagcttatttttgtattttcagtagagacggggtttcaccatattggccaggttggtctcaaactcctggcctcaagtgatccacatgcctcagcctcccaaggtgctgagattacaggtgtgagccactgcacccagccttggctatcatatttctaatttatgatagtttttcttgctttcttattgttcattttttatagcatcctgttcttatgttatggatatatatcttcaggtctcgctgaagaaataaagaggtgtatgtgtatatgtgtgtgtgtattatttttatttttattttttgagacggagtctcactctgttgcccaggctggagtgcagtggcacaatcccagctggctgcaacctctgcttcccaggttcaactgatcctcccacctcaatctcccaagtagctgggattacaggcacctgtcaccatgcccggctaatttttctttctttgtttcttttttttttttttttttttttttttgagatagagtctctgttgcccaggacggagtgcagtggtgtgatctcggctcactgcaagctccacctcctgggttcaagagattctcctgcctcagcctcccaagtagctgggattacaagcgtgtgccaccacacccagctaatttttgtatttttagtagagatggggtttcaccatgttgtccaggctgatctcaaactcctgacctcaaatgatccaccttcttcagcccgccaaagtgctgggattacatgcatgagccaccacaccagcaaaatttttgtatttttagtagagatagggtttcgccatatgtgtgtgtgttttaagtttttctgttttcatttctcttggcatatatacctcggaatggaattactgggtcatatgggagctctgtgttaaacacttgtgtcatatctaagaaaacttgctaatccaaaggtcataaagatgtatgtctatgttttcctctaaggccaacatggtgaaacactgtctctattaaaaaaataaaaactgggccgggcatggttgctcatgcctgtaatcccagcactttgggaggccaaggtgggtggatcacctgtggtcgggagttcgaggccagcctgatcaacatgcagaaaccccgtctctactaaaaatacaaaaaaattagcagggcatggtggcgcatgcctgtaatctcagctacttgggagctgaggcaggagaatcgcttgaacgcaggaggcagaggttgcggtgagccaagatcgtgccattgcactccagcctgggcaacaagagcaaaactcggtctcaaaaaaaaaaaaaaaaattagttgggcgtggtggcgcgcacctgtagtcccagctactccagaggctgaggcaggagaatggcttgaacccaggaggtggaggttgcagtgagctgagatcatgccactgcactccagcctggcaacagagcaacagagcaagactccatctaaaaacaaaaaaaagagttttctacttttcagtctaacaaatgttttataaacaaaggctttgttatattttgagttaatttttatagataatatgaggtgaggtttcaacttcattctattgtgtgtgggtatccagttgtcccaggaccattgtttgaaaagacttttttttctacactttctctcattgaattgtcttggcatatttgttaaaaatcagttgaccttggctgggcaccatggttcacacctgtaatcccagtattttgggaggccaaggcaagaagaccatttgagcccagaagttcaaaacccgcctgggcaatataggcacactccatttctaaaaataattattaaaaagattagctgggcaggccagacatggtggctcacgcctgtaatcccagcactttgggaggccaatgcaggtggatcacctgaggtcagaagttcaagaccagcctgaccaacatggagaaaccccatttctgctaaaaatacaaaattagtctggagtggtgactcatgcctgtaaatcccagctactagggaggctgaggcagaagaattgcttgaacccagaaggcggaggttgtggtgagccgagattgcgccattgcactccagcctgggcaacaagaatgaaactctgtctcaaaaaaaaaaagattagctgggcgtggtggcacatgcctgtggtcccagtgacttaggaggctgaggcagggggatcgggagacggaggctgcagtgagccttgatcactgcactccagcctgggtgacagagtgagaccctgtctcaaaaaagaaaaaaaatcagttgaccgtaatgtgagcactcatttctggactttcaattctattccattgatctatatgtcagtccttatgccagtgcccaggggctcaactactggtactgtgaattagattttgaatcaagaagcgtgagtcttccaattttgttcttatttttcaagattgttttgtctatttgaagttccttacaatttaatgtgaattttagaatcagcttgtccatttttgcaaaaaaggtagttgggattttgatagagattgtgttgagtctgtagatcaatttgggaggcattgctatgtgaagagtagtaagtgtttcaatccatgaacacacaatgtcttttcatgtatttaagtttaatttctttcaataatgttttgtagtttgcacttccttggttaaattcattcctaagttttttttggtgccattacaaatggaattgttttattaatttcatttttggattgttcatttctagtgtatagaaattcaactgagccaggtgtagtggtgcaccacctgtagtcccagctacttgggaggctgagtcaggaggattgcttgtggccatgtttgaggctatagtgcattataattgtgcctgtaaatgatcactgcattctagcctcggcaacatagtgcagtcttgtctcttaaaaaataaataaataaacaactgatttttgtacgttgatcttgtatcctccaactttgcaaaattaatttattactattaagactttgtggctgggcacggtggctcatgcctgtaatcccagcactttgggaggccaaggcgggcagatcacgaggtcaggagatcgagaccatcctggccaacacggtgaaaccccgtctctactaaaaatacaaaaaattagccaggcgcggtggcaggcacctgtagtcccagctacttgggaggctgaggcaggagaatggtgtgaacccgggtggcagagcttgcagtgagccaagatagcgccactgcagtccagcctgggcaaaagagtgagactccgtctcaaaaaaaaaaaaaaaaaaaagattttgctttattttgtgtttggtgtggatactttaggaaccaaaagataaataaataagaacaaggtctagcactttggtcaaatttattcctaagtgtgtgtttgtaaacgatattgtaaatgaattttcttagtttcattttcagcttgctaattgttactgtatagaaatacaatttatttatttatttactttttttttttttttttgagacagtctcgctctgttacccaggctggagtgcagtggtgtgatctcggctcactgcaacctctgcctcctgggttcaagcaattctcttgcctcagtctcccgaacagctgtgattacaggtgcgtgccgcaacccccagctaatttttgtatttttagtagagatgggttttcaccatgttggtcaggttagtctcaagatgttcttttttttttttttttttatcattttatttatttattttttaatttttatttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcctgcctttctattccacaaagccgccattgtcatcctggcccattctcaatgagctgttgggcacacctcccagacggggtggtggccgggcagaggggctcctcacttcccagtaggggcggccgggcagaggcgcccctcacctcccggacggggcggctggccgggcgggggggctgaccccccccccaccggtcaggttagtctcgaactcctgacctcatgatctgctcacctaggcctcccaaagtgctgggattataggcatgagccactgcgccaggccaattttttttatatcactcttacacctgcaactttgctgaatttgtttacttgttctgacggttttgtggattccttagaatttcctacatacaagatcatgtcatatgcaaatacatatggttttatttcttcctttctaatttgtgtggcttttatttctttttcttgctaatttcctggctagaaatttaagtataatgttgaatagaggtggcaagagtgaatatccttgtcttcttcctgatcttaggagaaaaacttatagtctttcatcattaagtattacctgtggggctggatgcgatggctcaagcctataatcacagcactttgggaggccaaggcgggtggatcatttgaggtcaggtgttcaagaccagcctggccaagatggtgaaacccccatctctactaaaaacatctctactaaaaatataaaaacttggcggggtgcagtggctcacacctgtaatctcaccactttaggaggccgaggcgggcagatcacgaggtcaggagatcaagaccatcccggctaacacagtgaaacccatctctactaaaaatacaaaaaaaaaaaaaagaaaattagctaggtgtcgtggcacacgcctgtagtcccagctacttgggaggctgaggcaggagaatcgcttgaacccgggagacagaggttgcagtgagccgagatcacaccactgcgctccagcctgggcgacagagcaagactccatctcaaaaaaaaaaataaacgtaaattagacaggcatggtggtgcgcacctgtagtcctagctactcaggaggctgaggaaggagaattgcttgaacctgggaggcagaggttgcagtgagtcgagagcatgccactgcactccagccagggtgacagagtaagactctgtctcaaaaaaaaaaaaaaggatttatgggaagtaattaaggtcaaatgaggtcataaagctgggcactgatctaatagaattagtgtctttatgagacgagaacccagagagctccctagctttctctctgccacatgaggccacttcaagaaggcaagccaggtaataaagcccacgctgaggtaggaggtggaactggactccagagatggggcttggacaccagaccaaattgatgactagctgaaacagggacagggtgaaagcagctttccataagacacgctcaaccagtgcaccatgtcagcttaccatttccatggcagaacccagagttaccaccccaccgccttttttttgagacggagtctcactctgtcgcccaggctggagtgcagtggcacagtcttggctcactgcaagctccacctcccgggttcaagcgattctcctgccttagcctcccgagtagctgggattacaggcgcctgccaccgcgccaaactgatttttgtatttttagtagagacagtgtttcaccatcttggccaggctggtcttgaacttttgacctcatgatccacctgccttggcctcccaaagtgctggaattacaggcctgagccactgtgctcagcctaccacccctttcaatggcaacaacttgacaacccagaagttatcagcctttttctagaaacgtctgtatagtctgccccttaatttgcatgtaattaaaggtcaatgtaaatatgactgcagaactgccctgagctgctactctggtcacactacctacagggtagccctgctctgcaaggagcagtccctctgctgttgctataggccactgcttcaataaaagttggcatctaggccaggtgcagtgggtaatgcctgtaatcccagcactctaggaggctgaggcgggtggatcatttgaggccaggagtttgagaccagcctggtcaacatggtgaaaccccatctctactaaaaatacaaaaaaattagttgggtgttttggcgcacacctgcactcccagctactcaggaggttgaggcgggagaatcacttgaacccaggaggcagagtctgcagtgagccactgcactccagcctgggtgacagagtgagaccctgtcccgaaaaaaaaaaaagttggcctctaacaccttcggtttgcccttgaattatttcctgggtgaagccaagaaccctctcagtctaagccccagttttgtggcttacctgccctgcatcaacaccagaaacttaaccctttgggaatctcgatcttggactttctagcctctagaaccatgagaaaatgatctgtattattaggctacccagtctatgatattctgttgtagcctggggtgactaagacattgagcctgtatgacttgaattttgttacctgcttggccccttgatggcatttcagtttgtgactcttggtttacgtgatcacgaagccaaaactgtttaggaaggaagcaaaatcaagacagattaaaaataaaaataaaaaataaaaggctgggcaccgtggctcacgccctcccagcacgttgggaggcaaaggtaggcagataacttgaggtcagcagttcaagaccagcctggccaacatgatgaaaccacatctctactaaaactacaaaaattagccaggcgtggtggtgggcacctgtaatcccaggtatttgagagggaggcaggagaatcacttgaacctgggaggtggaggttgcagtgagccgagatcacaccactgcactccagcctgggtgacagagcaagactctctctcaaaaaataaaataaaataaaataaaataaaataaaataaaataaaataaagagccgagcacgctggctcacacctgtaatcccacacttcgggagaaagaggtggcaggattgcttgagcccaggagtttgataccagcctaggtaacatggcaaaatcccatctcaattttaaaaaaattttaaaaaagaataatagggctgggcacgatggctcatgcctgtaatcccagcactttgggaggccaagatggatggatcacctgaggttgggagtttgcgaccagcctgaccaacatggagaaaccccatctccactaaaaatacaatattagcaggtcgtggtggcacatacctgtaatcccagctactcggaaggctgaggcaggagaatcgcttgaacctgggaggtggaggttgtggtgagccaagatcgtgccattgcactccagcttgggcaacaagagtgaaattccatctaaaaaaaaaaaaagaaagaaagaaataaggtattttacataaagattaaaaagaaattaaaaccattatttgaagataatggcttaaacagaaactctgcaaatccttagaataagaaagttcaggccaggtgtagtggcttgtgcctgtaatcccaatgcattgggaggctaaggtcggaggattgcttgagcccaggagtttgagacaagccgggtcaacataatgagatcgcatctctacaaaaaattgaaaaatgagccaggtgtggcagtgcgtgcctgtagtcctggctactcaggaggctgaggtgggaaggtcacttgagcctgaagagttcaaggctacagtgttatgatcatgccactgcactgcactccagcctgggagacagagcaagaccctgagaccctgtctcaaaaaacaaaataaaaaaccctcactatattgaacacaacatcaatgttcaatagccactctccttctccttttctaataaaattccacttttttgtgttccatcccaggaccacgatttatctaaactggtcattctggatcaataagtttggctaaaaataaataatatcgaaattggtcacaggaaatctattcttttttttttttttttttttttttttcagacaaagtctcactctgtcgcccaggctggagtgcagcagcatgatcttggctcactgcaacctctgcctcccgggttcaagcaattctctgcctcagcctcccaagtagctgggattacaggtgcctgccaccacgcctggctagtttttgtatttttagtagagatggggtttcaccatcttggccaggctggtcttgaactcctgaccttgcgttctacctgccttggcttcccaaagtgctgggtctgtcacccaggctggagtgcaatggtgcaatcatggctcactgcagcctcaacctccctgggctcagatgattctcccaccttagcctctcaagtagctgggattaaaggcatatgccaccatgcccagctaatttttctattttttttgtagagacagggcatccctaccttgcccaggctggtcttcaactcctggtttcaaaggatcctcctgcttcagcctcccaaagcactgggtctattattccctttcatattcaaacttaattctgcattttcaaggccttgaattttcaagggcagctttttctgtccctgaacttaatcttcagctcctctcacctcctgggaggttggggggtggggaagaaaagtcccaaccctctaatcctgctttggtcttttgccgccagcccccatcctgaagctaccagtcaatttgtttgcatacaagaagatatcactttggagattctaagtgtatacgaggaaatgaggtcaaagaccaaatatatatatttcactatatcacacttcaaacttttgtttactgtttcccttctcctactctattataaacctttgagggtggggactgtgagttatttatctttatattcccagtgtcaagagtgtttagctataatgggaatgaatctcaaagtttcttgaataaatgacaagaagaatcatagttgcatgaactaaattcattattctcagtccttgaggtaaatgaatatattgatattatgtctgcttactctttttttgcgagagagagaaagaggagggagggagggaaggaaggaaaaaaggaaggaaggcgaaaagagtgaaagaaaagagagagaaaaagagagagaaagaaggaaggggagggaaggaaggaaaagaaggagggaagaagggaaagggagggagaggaagaaaagaaagaagaaggaaggaaagaaagaaagaagaaaaggagggaggaaggaacgaagaaagggaaagaaggagggagggagggaaatgaaggaaagaaagaaaaaagaaagaaagaaaaaagaaaagaaaaggagggaggaaggaaggagggagggaaggatggaagaaagggaaagaaggagggaggaagggacatgaagagaataaagaaagaaagaagaaaagaaaagaaaaaagaaaagaaaagggagggctctgcgggcggcggcggcgcggggagccggttgcaggccgagatgctgcagatggacctgatcgacgcgacgggggacactcccggggccgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgcagttgtctcaggacacactgaataataattctctgggcaaaaagtacagttggcaggatcgggtgtctcgatcatcctcacccctgaagacaggggagcagacaccaccgcatgaacccatttgcctgagcgatgagctgcccccccagagcagccccgcccccaccacagatcgaggcacctccaccaacagcccacgctgctggagctggtgagcctgcggccgtgcttcagagactacagtgacgagagtgactcggccatcgtctacgacaactgtgcctccgtctcctcgccctatgagtcagccatcggagaggaatatgaggaggcctcccggccccagcctcctgcctgcctctccaaggactccacgcctgacgaacccgacgtccatttctccaagaagttcctgaacatcttcatgagtggccgctcccgctcctccagtgccgagtccttcgggctgttctcctgcatcatcaaccgggaggagcaggagcagacccaccggaccatattcaggtttgtgcctcgacacgaagacgaacctgagctggaagtggatgaccctctgctagtggagctccaggctgaagactactggtacgaggcctacaacatgcgcactggtgcccggggcatctttactgcctattacgccatcgaggtcaccaaggagcccgagcacatggcagccctggctaaaaacagtgactgggtggaccagttccgggtgaagttcctgggctcagtccaggttccctatcacaagggcgatgtcgtcctctctgccgctatgcaaaagattgccaccacccgccggctaaccgtgcactttaacccgccctccagctgtgtcctggagatcagcgtgcggggtgtgaagataggtatcaaggccgatgactcccaggaggccaaggggaataaatgtagccactttttccagttaaaaaacatctctttccgcggatatcatccaaagaacaacaagtactttgggttcatcaccaagcacctcgccgaccaccggtttgcctgccacgtctttgtgtctgaagactccaccaaagccctggcagagtccgtggggagagcattccagcagtttcacaagcagtttgtggagtacacctgccccacagaaaatatctacctggagtagccgcgcagccccgccctctgcgtcccccggccctcaggccagtgccaggacagctggctgctgacaggatgtggcactgcttgaggaggggcacctgccaccgccaggggatgaggaagtgggggccgctggctcagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccatacctcccctgccagggctcgggtgctctggctcctgccttgatgaagcccatgtcctgccttgatgaagcctgtgccacctgcaagtgcccgccctgcccctgtcccaacacccaccgaagagccctgagctcaggctgagcccagccacctcccaaggactttccagtgaggaaatggcaacacatggaagtgaagtccctgttctcagctctgtcatctgcagggcttctgggtggctcctgccactgacctcactggcatgctagcctgtggcaggcctaggacctcagcggggaggaggagctgctgcaaggccctatcccagcaggagagggaggcttcctgactgacacaggctagccccatcttggtcctgtcaccctggccccaactattaaagtgccatttcctgtcaaaaaaaaaaaaaaagaaaagaaaagaaaagggagggagggagggaggcaggaaggaaggaagagagggagggagggaagggaggaagaaagggaaagaaggagggagggagggaaatagaaagaaagaaggaaagaaaaagaaagaaagaaagagaaataaaataaaaattaaaaaaccataaggttaaagtaaaccctttttcttcatacagattaaaacacatgacttcaaattacagctttgcttcttaatagcttggtgatgtaggacgttatgtaacctctctgtgcctcagtttcctcatttataaaatagggcaataataatatctagcccataaggcattgtgaggattaaatgtgaaatgctgatcacaaatacctagcagcccaatagatactcactgtaataattattatttttataatttctgcaaaagtatggtgatgattcttgggttaacctaaaggcagattttcttttatttcttcctgtttcttttcttttccttgttcactttaaagaattaaaaagaaaattgattccagcattttggaataaaaatttgcatcaaaaagaatttattcattttattgacatacaaataaaatgtcatttgtttattcaataaacatttattaaatgtctggtaaatttcagacatcatgccaggcacagggatgacaatgacaataagatgtggtctctgccctcagggagctgatagtccaggagactgacaagtagacaggtgattacatgcaatgtaacaaaggctatgatgtcatacaagaagacaagtgggagtatgtgatgggagtatggttttgaccagttcctcctcttagatttatccctttttctttggctataaagcaaaagaattggtcctatttttttttcttaactttgcaaattaaaccataaattttaataactttataaagataaaaggcaagcggtcagattcagtggctcacacctataatcccaacactttgggaggccgaggcaggtggataacctgagatcaggagttcgagaccagcctggccaacatcgcgaaaccctgtctctactaaaaatacaaaaattagctaggtgtggtggcaggcacctgtaatcccagctactcaggaggctgaggcaggagaatcgcttgaacctgggaggcggagtttgcagtgagatgagatggagccattgctctccagcctgggctacagagcaagactctgtctcaaaacaaaacaaaacaaaacaaaacaaaaagatgagcaacttgaattatggaggacactagaaatagtgtttcctacagaatcagggcttcctaccaacatagtcacttctagggttttcgacctgaaaagttctgtggcatattgtttctttgctatccacttttttttccctatttttccccctctttctctcctctactttatctcctagagatctaggtagttcccaaaggaataatgctttacggagtctaatgttgatttattaggtaaaaacagaaaatgacttttttttttacccacaagttccataccaaaaaatgaatgtaaacttcttatgcagtttcacacattgaaaatgcaggttattttaattccattgcatttttcagaattctcaatcgcaatcctctgacaactgttgaagatccgtatctctttaaattactggcattaaaatatctgtaagtactatagtactcttgggagtcatgagatgatttatactctttttaaatttttcatcaaagattaagtattttgcatttaggctaaaatgtcataatttaaattttaactgagttattgaaaaacattattggcaaaggaaaggatgtgtaatggtcaagatagccagcaggggaaagagaacagtgttgaagaacccatatagatttggaacatgtagacacatggaggaatattacttaaccaagaaagcaaaggggaaaaggtgttcattattctaaaaaggaagaaaagagtaaataatcaagatgggtgaatgcaatatgaaaatgagaagtaagataatggtaaaaaaaaaaaacagtgtaagacctactcttgaatatcattaatttgatgatgcaaatcaactttaatttctttaataagagctctctggaattttgcggcaaataaactgttgaactggcttgttttatagggaagccaaaattgaagtaatcacatgtccttgaattatctttttaagtacagaattttttactggggttcatatcatgaatgtttcggctttcttcttcagagacgtgggaacaacgcaagtcccacttacaacacttaagaacattctcatgatgaccgttgaactggaaaaactgtaagttatttttttcttagacttattttcaccctgttgcgtttttaggtttgttttattattttcttaagtcaggtttattgagatataattttcatatactaacattcaccctttttaagtgtacaatttgatgagttttgacaaatgtatagttacataaccaccaccacattcccaatataaagcatttctgtcgcctcaaaaaggtccctcgtgtccctttgtagtcaatcacctcctcccaccgtcagcccctgttagctactaatctgatttcctatagttttgccttttccagaatatcttataaatgaaatcatatagcatgtagcctcttgtatttgacttctttcacttagcataattttttcttttttgagatggagtctcactgttgcccaggctgcagtgcagcggcatgacctagactcactgcaacctccacctcccaggttcaagtgattctcctgcctcagcctcctgagtagctgggattacaggcacatgccaccacgcctggctaatttttgtatttttagtagagacgaggtttcaccatgttggccaggctggtttggaagtcctgacctcaagtgatccgcccgccttggcttcccaaagtgctaggattacacgtgtgagccacctcacctggcctcacttatcatattattttttgaaattatgctgccatccatgttgctgcacccatcactacagctggccctccatatctgcaggttcctcatccatggattcaactgaacatggatggagaatacttgaaaaaaatgaaatatataaaataactataagacaataaaaacagtagaaaatttaaaatacagtataattatttacataccatttacactgtattaggtatttaaagtatacctgaggctatatacaaacattatgtcatttcatagaaaagacttcagcatctgtggactttggtgtcggcagggggtcctggagccaatcccctgcagacaccgagggacaactgttcactcctttttattgctcagtagtattccagttgtgtggaaaccccatctctactaaaaatacacaaattagccagatgtggtggcacacacctgtaatctcagctactcaggaggctgaggcacaagaagtgcttgaagctgggaggtggaggttgcagagtctcctttacacttgctgtcctccctccactgccgcctgacacactcctccccagcagtggcctcttcataggcaaatttaaggagcaccttttagtccttgtcctgcttgacttggccctgatgtttgaaattcttgataaatctttcttccggaaacacactctttctatgcttccaggaaatctttttcttggttctccagacaacttcttagactccttgaccaattccttcttgttgccaacaatggaaacaaaccagccctacctaagcaaagcacattaaaactcactagaaagatacaggggagggggcgcccactaaaccactaaagagacaggaggtggggagctgtaggaccaggtttgggaacctgcaagaatcaagaccagagcccctgaaatagcaagaagctggaagcacaggaactgtcagagccagatggctgtcactgcagtcagcgcctctgattgtttgtttttgagatggagtctcgctctgtcgcccaggctggagtgcagtggcatgatctcggctcactgcaacctccacctcccgggttcaagcaattctcctgcctcagcctcccgagtaactgggactacaggagcctgccaccatgcccgactagttctttatatttttaatagagatggggtttcaccatgttcgtctcaaactcctgaccccaggcgatccacttgcctcggcctcccaaagtgctgggattacaggcgtgagccaccatgcctggccagtttttgtatatttagtagagactggttttgccatgttggccaggttggtctcaaactcctgacctcaagtgatccatccacctccgcctcccaaagtgctgggattataggcatgaaccactgtgcccagccacctctgatagttttcatcgtcctcgggccactggctcccaaatcacggttccagacaaaagcttacaagtagtccagctttggccaggctcagtgtgatggttaatactgagtgccaacttgattggattgaaggatacaaaatattgatcttgggtgtgtccgtgagggtgttcccaaaggagattaacatttgagtcagcgggctgagaaaggcagacccacccttaatctgggtgggcacaagctaatcagctgccagcaaggctagaatataagcaggcagaaaaatgtgagagactggcttagcctcccagccaacatcttcctcccgtgctggatgcttcttaccctccaacatcggactccaagttcttcagttttggaactcagactggctctccttgctcctcagcctgcagacggcctattgtgggaccttgtgatcctgtgagttaatacttaataaactcctgtatatattccattaattctgtccctctagagaaccctgactaatacgctcagtgactcacacctgtaatcccagtactttgggaggctcaggcaggaggatggcttgagccccagagtcttcttcttctccttctccttgtccttctcttcccttcccctttctcctcttcctcttccttctcttcctcttcctcttcctctccttcctcttcctcttcttcctcttgtttgtttgagaaaggttctccctctgttgccaaggctggattgtagtggcacaattgtgactcactgcttctcagcctcctgagagcccaggagtttgaggctgcagtgagctatgatcacactaccacactcctgcctgggtgacagagcaagaccctgtctcaaaaaacaaacaaaaaactctggtatgatagaggtgaattgtctgttttatcctgataattctgcttaccttagtcccgtggttctcaactgggccaattttgctccccaagtgacatttggcaatatctgggcagaggtcaaggacgctgcttaacatctttttttttttttttttgagacacagttttgctcttgttgcccaggctggagtgaaatggcacgatctcgcctcactgcaacctctgtctcccgggttcaagcgattctcctgcctcagcctcccgagtagctgggattatgggcatgcaccatcacgcctggctaattttgtatttttagtagagatggggtttctccatgttggtcaggctggtctcaaactcccaaccttaggtgatcagcccacctcagcctcccaaagtgctgggattacaggtgtgagccacctcacctgtcctgcttaacgtcttaaaacacacaggacaattcccccataaaaaatgatgaccagccgaaaatgtcaacagtatcaaggtgaagaaattgccataaaggcttggtaaacagggatggtatgacgacactattgataggccacattaaaatacttagggccatatccattatccctgtttttatgatttcttctttgtccccatgcagtttcaggggcaaaataagggagtaagtcagaggtggttccaaatagacatctgggaatcttagggtgtaatatggccctcatggaggcccttgctgagcttagggcctgattctggaatcctagcattgccaagagaggcaggctggcaggtgagaagacaaataatgggagagcccacatatgttggaattcatttgatggtatctaagctggggtgattgtccccactagcattacatgactatggatccagttatttggagaaatccatttcctccacagggaatatatactacattagaaccaaagatggaatccttagtaaatggaatcatttggcaaaattcagttgtctgaaatttttgcataaaattctcttttttattttcattgagccaaataaataaagtatcaggtatttactggggtcaccattctttgattcattgattttttttttcagacaggatctcgctgtcacccacgttggagtgcagtggcataatctcagttcactgcaacctccacttcctgggcttaagtgattctcccacctcagcctcccaagtagctggaaatacaggcgcgtgccaccatgcctccattttctttctttttttttttttttaattgatcattcttgggtgtttctcgcagagggggatttggcagggtcataggacaatagtggagggaaggtcggcagataaacaagtgaacaaaggtctctggttttcctaggcagaggaccctgcgccttccgcagtctttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtatagaacaaaatgaaaagtctcccatgtctacccgcctctacacagacacggcaaccatccgacttctcagtcctttccccacctttcccccctttctactccacaaaaccgccattgtcatcatggcccgttctcaatgagctgttgggtacacctcccggacggggcggctggccgggcggggggctgacccccccacctccctcccggacggggtggctgccgggcggagacgctcctcaattcccagacggggcgactgccgggcggaggggctcctcacttctcagacagggcggttgccgggcggaggggctcctcacttctcagacagggcggttgccgggcggagggtctcctcacttctcagatggggcggccgggcagagacgctcctcacctcccagatggggtcacggccgggcagaggcgctcctcacatcccagacggggcggcggggcagaggcgctccccacatctcagacgatgggcggccgggcagagacgctcctcacttcctagatgggatggcggccgggcagagacgctcctccctttccagactgggcagccaggcagagacgctcctcacttcccagacggggtggcggccgggcagaggctgcaatctcggcactttgggaggccaaggcaggcggctgggaggtggaggttgtagccagccgagatcacgccactgcactccagcctgggcaccactgagcactgagtgaacgagactccgtctgcaatcccggcacctcgggaggccgaggctggcggatcactcgcggttaggagctggagaccagcccggccaacgcagcgaaaccccgtctccaccaaaaaaatacgaaaaccagtcaggcgtggcggcgcgtgcctgcaatcgcaggcacttggtaggctgaggcaggagaatcaggcagggaggttgcagtgagccgagatggcggcagtacagtccagcatcagagggagaccgtggaaagagagggagagggagaccgtggggagagggagagggagggggaggggagggggagagggagagggagaggtgcattttcttataaacccaatttcctctttagtgcaactctaccatttgaaaggaacctttctattgtaatttacaagctgtgaataaccgctatgtaattctttccaaggattaataaactgagagaggatttgaaccaacagaggtaggggaagattagaagggggatgcaagtggccacagatcttagaggcggccagcagagggcgctgctccaaggtgaaggtcgcaccctgagaggccatccttttttgtaggaccagactggggtgtaaggacagtgcctcatcctcacaacgacagacccgtgttctgggtgtggatttgcctcccttgcctgcgggacttctgctagcactgccgttcctagacttagaccatgctagaatgagtccaggaaccgaggagaggagatgggagtggctcctcccactgtggcccctaataattcacatgaagaatttttgctttccttgccagggacccgggactcagtgggtccagaggtcctagtgccaaaggaagaaatgtgtagatcaggaaatactattatggttttattcaactggaagccgaggctggccatttattgtatttatttatttatttatctatctatttatttatttatttagagacagaatctcactcttgtttcccaggctcccaggctcaagagatcctcctaccttagcctcctgagtagctggtactacagtcgcatgccaccttgcccagctaattttttttttttttgagacgcagtctcattttgttgcccaggctagagtgcagtggcgcggtcttggctcactgcaacctccacctcctgggttgaagcgattctcctgtctcagcctccggagtagctgggattacaggcatgtgccaccgcgcctggcaatttttttttttttagtagaggcggggtttcaccatgttggccaggctggtctcaactcctgaccttgtgatccgcctgcctcagcctcccaaagcactgggattgcagacataagccaccgcgcctgttttttttgttttgttttgttttctgacagagtctctgtcacccaggctggagtgcagtggtgtgatctcagctcactgcaacctctgcctcctgggttcaagcgattctcctgccttagcctcccaagtagctgggattataggcgcacaccactatgcccagctaatttttgtatttttagtagaggtggggtttcaccatgttggccaggctggtctcaaactcccgacttcaggtgatccacccacctcggcctcccaaagtgctgggattataggtgtgagccatcaagcccagccctgcccagctaatttttacactatgggcaagtatgctgcccaagagtgctctggaactcctgggctcaagtgatcttccttcctcggcctctcaatgtgcttggattacaagcatgagccaccttgcccagccgaagctggccatttaaagttcctcatgctgctgaatcaataaggatggaaggcggctactattatgggctaagtgtttgcatcctccccaaattctttttttttttttttttttgagatggagttttgctcttgttgcccaggctagagtgcagtggcgcgatctctgctcactgcaacctccacctttcaggttcaagtgattctcctgcctcagcctaccgagttagctgggattacaggcatacgccaccacacccggctaattttgtatttttagtagagatggggtttctccatgttggtcaggctggtctcaaactcccgacctcaggtaatctgctgacttcagcctcccaaagtgctgggattaccagcatgagccaccgcgcccggcccccaaattgttttttgttttttttttttgagacggagtctcgctctgtcacccaggctggagtgcagtggcatgatcttggctcactgcgagctctgcttcctgggttcacgccattctcctgcctcagcctcccgaatagctgggactacaggcgcccgccaccacgcctggctaattttttgtatttttagtggacacggggtttcaccgtgttagccaggatggtctcgatctcctgacctcgtgatctgcctgcctcagcctcccaaagtgctgggattacaggggtgagccaccacacccggcctcggcccccaaattcttatgttgaagccctcacctccatgtgatggtattagaaggtggggcctttgggacgtaattaggctgacagtgccccatgatgggatgagtgtcttaaaagaaaagaccaggtggtctggctagtggctcacccctgaaatcgcagcactttgggaggccaaggtgggtggatcacttgagatcaggcgtttgagaccagcctgggcaatatggtgaaaagccatctctactaaaaatacaaaaattagctgggcgtggtggcgcaagtctgtaatcccagctacttgggaggctgaggtgggagaatcgcttgaacccaggaggtggaggttgcagtgagcccagatcatgtcattgcactccagcctccaacctggacagagagagcatctggagagtctctgtctcaaaacaaaaagaaaaaaaaaagaagagaccagagagcctttcttctctttgtccaccaagtgaagatatggcaagaaggcagccatctgcaagctaggaaaagagcccttgccagcacccaattgtgctatcaccctgatatgggacttcccagcctccagaactgtgagtaatcaatgtctattgtttaagccacccagtatgtaatactgagctgactaaaaccatcaccgaactagcctctttacatatgattagcaagaggaaaatggctctgttacttaatggaggaaggaggctatgtctgaaagccaaaaattcactggggacacatcttagcaggctcttgaccctaagacctggttaatggaaaagtagagcaacccaataaaaacaagaccaccaagaagtcaggtcttatggaataaagtattgagtgtccctatgaggcacagaacccttcgaaaggggattggaagaagtggtgaagaaggcggctatgattatcaacttagacttcatcgccatttgtagaaggaggcttctaacagctatgttttatgttaattggctcttttctcttcttttttctttcaaccttatattaagagcactggcagaagctagcggttttggcatcctgtaattattagctgtataaccttggccaagtaactcaacctttctgtgcctcagttactcatctgtaaaacagggtaataagtctcaacctcgtacttatgttgttataaagatttaacactaggctgggcatggtggctcacacctgtaatcccagcactttgggaggccgaggagggtggatcacctgaggtcaggagttcaagaccagactggccaacatggcaaaaccctgtctctactaaaaatacaaaaaattagctgggtgtggtggcacgtgattgtaatcccagttactcgggaggctgaggcaggagaattgcttgaactaaacctgggaggcggaggttgcagtgagccaagatcgtgccactgcactctagcccaggcaacagagttagactctgtctcaaaaaaaaaaaaaaaaaaaaagtaacactttgaacaaaaaagaaaaaaataataaaatttaaaaaagatttaacaattgggccaggcatagtggctcatgcctgtaataccagcactttgggagcctgaagagggaggattacttgaacccaggagttccagaccagcctggacaacaaagcaagactttgtttctacttaaaaaaaaaaaaaaaacaccaaagtcaggtgtggtggtacacacctgtgatcccagctacttgggaggctgagatgggaggatcccttgagccttggaggttgaggctgcaatgagccatgatcataccactgcactccagcctaggcgacagagtgaggcccatgtcaaaaaaaaaaaaaatgatccccaacatttagcagcttaaaacaaaaaacatttattatatcacactttctgtgggccaggaatctgggagggacttagctgggtggttctgctcagttctcttgggatgtttcagtcaagcagtggcctggggctgcactcttatctgaagactcaattgggagaaaatatgcattcaaggtcactcattggttgttggcaggctgtagttccttactgaatattggttgaagacttcattggcttactacctggacttctccatagactgcttgaatgtcctccccacatagctagagtgaatgactaaaaaagagagagaacacacacagcccaggtaagagttcagtctttctaagtcattatatgaaagagattcttttttttttgagatggagtctcgctctgtcgccaggctggagtgcagcggcacgatcccagctcactgcaacctctgcctcctgggttcaagtgattctcctgcctcagcctcccaagtagctgggattacaggcgtgtgccactatgcccagctactttctgtatttttaatagagatggggttttaccatgttggccaggatggtcttgatctcttgaccttgtgatccacctgccttggcctcccaaagtgctgggattacaggcgtgagccaccacgcctggccgaaaaagattcttgcacacacatgtttatagtagcactattcacaattgtaaaaatgtggaaccagtccaaatgcccatcaatcaatgagtggctaaagaaactgtggtatagatatacagtggaatactactcagtcataaaaaggaatgaattaatggcatttgcagcaacctggacaggattggagactattattctttttttttttttttttttttttttgagatagagtctcacttggtcacccaggctggagtgcagttgtgcaatcttggctcactgcaagctctgcctcctgggttcacaccattctcctgcctcagcctcccaagtagctgagactacaggcgcctgccaccacgcccggctaattttttttttgtatttttagtagagaccgggtttcaccatgttagcctggatggtctcgatctcctgacctcgtgatccgcccacctcagcctcccaaagtgctgggattacaggcatgagccaccgcacccggcctattttttttttttttttttttttttttttttttttactaaccaggggtttaacataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaataaagaagattcatgctaagctgtggcagaggggggaaggtatgatcgggtgggggtgggataaggaatggccatggaagataactgggtcaggttggaccctgggctgggagggggagggcaaggcccctcaccacaacttaagccaaacctaagctgcccccaggtgccataggtccctgtcccagcagggaggctgatgggcctgggcccatgcccctccccacctttgggggtcagatagtggccacccaggtttgctgggttggggcctgatacaggctctgcatgcccattcgggctgcctgtggagagagaatggagtcactgtttaaccatgctacctgcctcagccccagcagaccacaggaggttggccccagactcactgagtgcctgcagcagccctacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttgggaccctaacttgtcccttgccaaggccaactggctgccctctggctgtggggaccgcaaggagggacccacaagctgctggcgaagtcgctgcttcagttctggcttgagccactccacagccacctgctctccacagaggtgtggctgcccttcctccagggcctttttggccatggcagcggtccagtgcgagctgaatttgagcagagcgatctgcccgggcgcaggtccggggctgggcagcagccgcgcctcctgcaggccgggacccagcggctgcagcgcgggcagcagcgcgggcagcagcgcggtgcgggtcagattcggcggcaggcagtcaacgctcagctcacacttcccggtgctgcggcacacgagcagcgggcaggacggccgcagcgggtggttgtgcagcgggcgatggcggcctgcgcgccgcgccgcgagctgcagcgggcatatgcgaagccgcggttcaggccgctgaaggtcatcatcaggcggaactcgtagaggcggcccacgcgctggaacagcaggatagctggtgctcatacacttcctgaggcagccgcccgatgaacacctctgacccagccggcggcgggctgcccacccagcctgggggtggcccgccatacttcctctgcccgttcacctgcaccaggcgatgcctgtctccctgacccacgcctccagcgccgccttcaccctctcacaccacagctcacaatcccgcttggactgcatggctctctattctcttttttttttttttttttttgagacgtagtttcactcttgttctccaggctggagtgcaatggcgggatcttggctcaccgcaacctccgcctcccgggttcaagcgattctcctgcctcagcctcccaagtagctgggattacaggcatgcgccaccatgcctggctaattttgtatttttagtagagacggggtttctccctgttggtcaggctggtctcaaactcccgacctcaggtgatccacccacctcggcctcgcatagtgctgggattacaggcatgagccaccgtgccccgtctatggagactattattctcagcgaagtaactcaggaatggaaaaccaaacatcgtacgttctcactcataaatgggagctaagctaggaggatgcaaaggcataagaatgacacagtggactttggggaatcagggggaaaggatgggaagggggtgagggataaaagactattaattgggtgcagtctatattgcttgggtgatgggtgcacacaaatttcacaaatcaccactaaagaacttacttacgtaaccaaacaccagctgttccccaatatcctatggaaataaaaatttttttttagaaaaagagttcggtctttctgtaacctaatcttggaagtgtatattatcacttcttccataggctatcagtctcccagaccaaccctgctacagggtaggggagactacatggtatgtgaataccagaaagtgggggccactggggactggctatttggaggatggttactacaaactatatttgtaattttttttttcttgagatggagtcttgctctgttgcccaggctggagtgcaatggcacgatctcagctcgctgcaacatccacctcctgcgttcaagtgattctcctgcctcagcctcccgagtagctgggattacaggcacgcaccaccacacccagctaattttttgtatttttaatagagatggggtttctccatgttggtcaggctggtctcaaacgcctgacctcaggtgatctgcccgcctcggcctcccagagtgctgggattacaggcccgagccatggtgcctggctatatttgtaatattttaaccactaaaaaaaaaaaaaagaagaagaagaagaagaaaaagaaacaagtatgggaaaatattaagatctgataaaaccgggttatacttatgcaggtattcattacattattctccataactttttaaatgtttaataataaaagtaaaaatattttccccttaaaaatgtgcagagcatacctcaaataatgttgacaaagaatcctaaagacaattattattattattattttttgagacaggttcttgctctgttgcccaggctggagtgcagtgatgccacctgagctcactgtaaactccgtctcccgagtttaagcaattctcctgtctcagcctcctgagcagctgggactacaggcgagcaccatcatacctggttaatttttatattttcagtagagacggggtttcatcatattgcacaggctggtcttgaactcctggcctcaagtgatccacccaccttggcctcccaaagtgctagcattacaggcatgagccactgcaccgggcctctcaaactcctgacctcaggtgatccacctgccttggcctcccaaagtcctggcattataggcgtgagccactgcgcccggccgatcttccttcctttctcccttcccctcttcttcttcttcttcttcttcttttttaattaatagagatgggattttgccatgttgcttaggctggtttcaaactcctgggctcaagctatctgctcgcttcagcttcccaaagtcctgggattaagggcgtgagccactgcgcctggccccagtaaggatttaaaagctcaggaattattagtcagcttccttttttgttcatcctgttgtttgttcatttcagtctattccctttttataatttccttcttcataaggactatttctccttgtacttttgtgagaattcccgtaacttgtaatcccagctacttgggaggctgaggcaggagaatcacttgaaccgggaggcggaggttgcggtgagccgagatcaagccattgcactccagcctgggcaacaagagcaaaactcggtcttggaaaaaaaaaaaaaagaaaagaaaagaaaaaagaaaggaaggaagatcctcattggacagagcaaaaagcagaattgatggcactgaaaatgaaatcagcagctgatgtacaagttccagaatgtctcctagagtaacaaggaaatccgggtgtggtagtttatgcctgtcatccaagcactttgtgaggccaaggaggttagttagcttgagcccaggagttggagaccagcctggccaacatggtgaaaccccatctctacagaaaatataaaagttagctgggtttggtggtgggtacctgtagtcccagctactctggaggcgaaggagggaggatcacctgagtcccgcgaggtcaaggccacagtgagccttgatagagttttgccactgcactccagcctaagcaacagtgagaccctgtctcaataaacaaacaaacaaacaaataaataattgtagagacagaagataaaatggagcccggtgcagtggctcacgcctgtaatcccagaactttgggaggctgaggtgggcagattacttggcccaggagtttgagaccagtctgcccaacatggtgaaaccccgtctctactaaaaatacaaaaattagccaggcatggtggtgtgtgcctataatcccagctacttgagaggctgagacaggagaatcgattgaacccaggaggtggaggttgcagtgagctgagatcacaccactgcactccagcctgggtgacaaagccagactctgtctcaaaaaaaaaaaaaaaaaaaaaaggctgagcacggtggctcatgcctgtaatcccagcactttgagaggctgagccgggcagatcacctaaggtcgggagtttgagaccagcctgaccaacatggagaaaccccgtctctgccaaaaatacagtattagcaggtcgtggtggcacatgcctgtaatcccagctacctgggaggctgaggcaggagaatcgcttgaacctgggaggtggaggttgcagtgagccgagattgtgccactgcactccagactgggcaacaagagtgagactctgtctcaaaaaaaaaaaaaaaaaaaagagagagagacagggtttcaccaggttggccaggctggtcttggactcctgacctcaagtgatctgcccgcctcagcctcccaaagtgctgggattactggtgtgggccactgcatctggctcccaccatctctattaaaataagataaaataaacataaaataatgaaccgacaaaataataatacaattcattgtaagtaaaatgctatcctgagttctgtgagtcattctggataattcaaattctctagaattaccacctcagctgactttttttttttttttttgtagagaccaggctggtcttgaattcttgagctcaagtgatccgcttccctcagtctcccaaagtgctggaattacatgtgtgagccactgagcctggcctacaaattctttattatacaacacacagtagatgctcaataaatatttgctaagcagaaacatacactcaaaataccagaaattatcaaggaagttgccagttggtctcttgggttcttcctcccgacaggtatacacacctattgtaaagatgaacacattaggctgtgagaaaccaatactgttaaacattccaatcaggtgacaaactccctgggctctggtttatattaccaagcaacctgatgataacttggcttcctgtgtggcttgtttatagaaagagaatgctacccaggctgacgtgagttgcatttctgagttgatttctcactgtaaattaataaactggcattctggctacatagatcagtctctttgaactctttgtaccttccaccattagtgtgatttctaaggctgcaagccagacactgcccaagacccagcactggactctggtgagttcttccagctgttgccaccccaggaggctctgggagcccctgggaaccatccagcttgctctctgtctctacatttcagggtgtgggtttcagggcattcacaacattcctgcaacagaagagttttgggaacacccccagcaggatgtgggtgatttgaatgtatgtcagagatgtggttgtaactgagaaatcttaagcctagtgaattttattccacttgacttaaataaagagcacgtgaaagaaggggatctgaggacatctatgaacagggccccgagggcatgaacttactagtgtttatatgactagtgtttatctgggcctgtctagtctggagaacctgactctggtgtacccaagctttgcagtggctgtagaggtttgctcttttggagggagaagataattcattcctccaacacctgaatgagggtagattaacccacctccttcagctgcaatttggcaaatttctcttctttgatttaatgctcaacggacaaatttcctttcttcttcttcttcttcttcttcttcttcttcttcttcttcttcttcttcttcttcttcttcttcttcctcttcttctttttttctcctcttcttcttcttcttctcctccttctccttcttctccttcttcttttctcttccttctcctcctccttcctcctcctcctcttcctactcttcttcctcttcctctcctcctcctcttcctcctcctcttccttcttcttcttctttctttttttttcggttttgagacagggtctccgtcacccaggctggagtgcagtggcacgatctcggctcactgcaacctccacctcctaggctcaagcgatcctcccacctcagcttcccatgtggctgggaccaaggcgtgagctaccatgcccggctaatttttgtattttttgtagagacagggtctctccatgttgctcaggctggtcttgaactcctgagctcaagagatcctcctgtctcaggctcccaaagtcctgggattacaagcacgagccaccatgcccggcctcaacaggcaaccttctgattaataattagacctctgtgccggccgtcgtggctgatgcctgtaattccagcactttggaaggccaaggcgggtggatggcttgaggtcgggcgtttgagaccagcctggccaacacggtgaaaccccgtctctgctaaatatacaaaaattagcctggcatggtggcgtatgcctgtaatcccagctacttgggaggctgaggcacgagaatcgcttgaacccgggaggcagaggttacagtgagctgtcatatataatgaaacagttttactaaacttaggaagcagtgacttggtgtctctagaaattgcctaacatacacattccaggatacattctctgtcatctggaatctcctcccttccacaaacccacgctgtcttaagcactattttcctatttgttgttgacctaatctagaaaaaagcggccatcactctttctcccccactcagtccctcagtcccgaaacacccttattctccgcacttgtcaccccaccctctgctgcccccaccgcagcgcgcaaacgcacacgagtttaaagtttaggctgtgatgctatcctcgcccgcagatcacaggacagacattctcggggacaactttgcgaggccatgtgctcgtcccccttaggaaggaagagggagaaatccctgcggctcggttttgttccaatggtctgctcagcgagtgattcccgtttccccaaaggctgcccctcattagcatgaacggggacgcgggtgtggagaaggggttagaggagagaaagcaagcaaaagcccaggctcacttttagagcctgggaaccctgtctgcaaaaatgacagctagagctttctggctcctctgtttaatcgtcggatcatcccccgaagctccggtggagagaaaaagtaagatcggtgtagtgcggagccctgggagcggagcggggatctggggagggggcgcccaggcctcagccgccggccgacaaccgggccaccttccgtgaggccgcacacgctcccacaggcccgcgcctggcgcaagccgagaaccgcgcgtcgccgcgccgcgggcccgcgacggaggaagccccgagacgcgcgcgctcacgggccctacgcttccccgccgcccggccgcgcgcgcgcgccgccgagggccccgccggccctgcccaccccaaccggccgcgcgccgttgtgccggcccccggctcgccgcccgcgccgccgccgcgcctcagcttcagattcggcctcagtcagccgcgcagggacgcggagcccggcgccgagctctgcgcttgcgcttgccgggcgggcatggacgggcgagaggcgttctgcaagcgcgaaatcggtgagcccggccgccgcgccgccgccccgcgagcctttccgagtcccggagaatcctgcacgcgagatcccagggcgcccgacccatgcgggccgtttcgctgttgctaaaaaccaacgcccagggactgggagaggaactggggttcccaaactgttttttggaagcagcgatgaacgggatagtgcatgacgtggacgtgctgggcgcgggcatctggctggtgaccctgctggtggatcgggacgggctgtacaagatgaaccgcctgtacctcactcacccccgacgtcttcttcttccgagtccacatgttagtcctggactcctccagctgcaataaaccgtgtccagagtttaaacctggtattgaaactgagctgaatgacgctgcatatgtactttataccaccgtttgtaacgtgggtgccacagcccgggctgtgggtcgtccagtctttttttgggacggatgggggacagtattgtaacatgattaggatttagacgacaggtattatttccgccactgtgatttaagcaccgtcagccccacccccacgggtgagaacggcagctgttggcacaaagcgggctgtcaataaatagatgttgacaaatggagtgagcgaccaccaaacaccattgccagaagggactgtacagaactgagtttagaaaagctgcttttttgggggagtgtgtggagggttggtagcggggaatacccactcccacatcttttttttttttttttttttttttttagacagagtctcgctctgttgcccaggctggagtgcaatggcgccatctcagctcactgcaacctccgtcccccaggttcaagccattctcctgccctcagcctcccaagtagctgggattacaggctgagccactgcgcccagccccactcccacatctttctaggcatgtgctctgggaaatcctgatacaatgtgataaggacctttgttctgtaatgtgggctggttacgtattgctttcccttccccacaccccgtgctactttttgtatttttagtacagatggggtttcaccatgttggctaggctggtctcaaactcctgacctcaagtaatctgcccgcctcggcctcccaaagtgctaggattaaaggcgtgagccactgcactggcctggttgggttggttatcttctaaaggtcgctagactgtttccaccttgcctgtagactaaatatcagtttcaacttgtgcagcaagatagtagattgcagcttaggtatttcttaaaggccttatattttctgtttcatggcatttaaaagacgctatgaattaatgttctggttattttgtccaggcagcaggtatattgtgatgggccacatctaccataagagagggcagcttcctacagctctgctccaggtcctgagaggccatctctgtccaggggatggactgctgaggagcagcagcagctatgtgaaaaggtttaacccaaaaagggaagggcaaattcaaggtgcaattcatacccaatgcatttgaaacaaccatcctggcatttctggatcacaagagacatcggcaacaagacatgaaaggtctatcttcatgtaatgggtcctcctttagaagagagcccaaagctactctatgaatgacctgcatagttacaactgtaatctcgaaggtgtcactttgttatttacaagatgcttcttaaatgggctgctcctgagctcagtgtcaaggtgattcaactgttgtgccagacagtgatttacacagctcagataactgacctgtctagttaacagatcactgcttcatgtttttaaatattttaatttaatacattctttagtagaaatagtccacaaaacattttcctgaatttaaatacacaacttttatatcatgtatcaaacctgattttatattcaaacctgatttatattcaaaacttatatgtgaagattaaattcttcacataacagtaagcgcactagtcaaaagacatttacctatgaaacgtcatttagatcaaacacaagggtcaaagcccaggacaaggattaaaattttacacttaaaaagtaccaagccgggcgcggtggctcacacctgtaatcccagcactttgagaggccgaggcgggtggatcacctgaggtccggagttcgagaccaggctgaccaacatggaaaaaccctgtctctactaaaaatacaaaaattagccgggtgtggtggcacatgcctgtaatcccagctgagggaggctgaggcaggagaatcacttgaacccaggaggcagaggttgtggtgagccgagatcgcgccagcctgggcaacaagagcaaaactccgtctcaaaaacaaacaaagtgtacaaaagggccagtgtgcggatgggtggattaaaaaaataaattttaaaaaagtgccaaagggcttacttcaggcaaaagtgttcctgatgtaccaaagagtaagatatagtttattttcatgcctccctgctcctaataatgtatgttttgtgctgaactggcagctatcccaatgtgaactgtattctgagtgtatctgatatcatttttctattaagaccaagtataatgtttgcttgtaaagcaataaatcttgctttgaaattagaccttggatgcacctgtttatttttgttttgttttgttttagcctttgagccctaaaggtttgagaaaaagcctttctcaaattcattccccaaaccttggaaccaatattaaccaatgacagctcacaagcaagtgaattctaaacatttttcagttggttttaaaaaggtttaatcactagctaaattaaatattgattttatacctgagtccacaaagacatgagagtattttttcagaagataaggctgtacttcagtttataagaagtacggtgaacagagacaccactaatgcatagatgaagatgactgcctaaagagagacaggggaaggaatttcactggagagagagcagcctatttggcctcacggtgatgcactcaggaaggtcagaatgtgtcctgacgctgtccatggcacccagtagtagcactgtacacataaaggacatccaggacgggacgctagggaatcacaggagccaagaggcaacagcctaacattacaatacctgatactattatttgttccaattatggggcagacaggtaataaagagttgagaggttctgagtgttctatggtaaagcactactgagagatttctagagtattttccaaaaatgagttttgtccaaatttattataaattttactagaattgctttttgggagtcagatgcattattgcatgatagaattatagctaatgaagagcttctgagctagttttctttaagataaaaaaaattaactcaggcataactcaggccagtcaaatcaaagttgaatttttaaatgtcaaaaggctaggccgggagctgtgactcacacctgtaatcccagcactttgggagaccaaggcgggtggatcacaaggtcaggagtttgagaccagcctggccaacatagcgaaactctgtctctactaaaaatacaaaaattagctgggcatggtggtgcatgcctgtaatcccagctattggggggcaggaggatcgcttgaacctagtaggcagaggttgcagtgagccgagatcatgccactgccctccagcctgggcaacagagcgagactctgtctgaaacaacaacaaaaagtatatctatatggctaatttctttagttgaatttggttcaaattggatcaagtggtataatcttctaagaaaagtcttttagtatctcactccaagtatctagaaataccttagaatgtttcaaattattaaaaatacttctcggttggctcttccctccacctcctcaagtacttcattattttatccatggaatatccccattctcacattaagggcaagaaatctgagacctatggtaatagtttcttttttttttttttttttgagaaggagtttcgctcttgttgcctaggctggagtgtaatggcatgatgtcagctcaccgcaacctctccctcctgggttcaagtgattctcctgctctagcctcccaagtagctgggattacaggcatgcgccactttacctagctaatttttttttttttttttttttgtatttttagtagagatggggtttctccatgtttgtcaggctggtttcaaactcccaacctcaggtgatccacctgccttggcctcccaaagtgctgggattatacgtgtgagccaccacgcccagccgtatcatgatagtttcaatcaggaagagtgaaagctgtaataaccatgtaactttgtctaactaagtgtgcagagatctgaaagtccaccaggttggctctttaacataaagaagtagagagtttgcctaaaggaattagcagaaatagggaaataacttttatttgcagatcccaggaaggtagattacaaacaacagcaaatcttagtgtctctaaataacactctaggccatttggaatataaaaaggtaattattttacttcagaaaatatctccaaaagttcactttttttttgagacagagtcttgctgtgtcgctcaggctggagtgcagtggcacaatctcagctcactacaacctctgcctccccagttcaagccatcctcccacctcagcctcctgagtagctgggactacaggtgtgtgccacttgtccagctaaattgttgtatttttagtagaaacagggtttcaccatgttggtcaggcaggtctctaactcctgaccttgtgatctgcccgcttcagcctcccagagtgctgggattataggcgtgagccaccatgcccagccacaattttatttaaacctcctgtagaatttggataggagaataaaagctttaccaataggaaaatacttttcatgaaatggtttcaaggattgtgaacttggcaggtgaagcataacagttattgaaaatacttttagccaaggaaatctactgatgcaaattaaatatatttacaagcccaaggcctgtggtagaaacatcctaagagtatcacaaatgtacagtttactgcctggattattgaaagcaaaatagctgtgttatatagatcttaatagcagaagctttcaaagattactcacagaaaagcagctttcagaactcattatgttctaaaaaatgtatgtttttctttcttttttattttttttgagatgaagtctcactcttgtcccccaggctggagtgcaatggcgtgatcacggctcactgcaacctccgcctcccaggttcaagtgattctcctgcctcagcctccctagtagctgggatttcaggtgcctgccaccatgcctggctaatttttgtacttttagtagagatggggtttcaccatgttggccaggttggtctcaaattcctgacctcaggtgatcccccctgcctcggcctcccaaagtgctggggttacaggcgtgggccaccacacctggccaggaatgtgtgtttttcaaaaattacttttgaaagactaaagccctatagttgataaaactataaaatgtctttatgtatttgtatggtgatagaaactgtaaaacactttataccattaaatacacatgaaattaatatcttcctggtctcaggatttccataaaatttaccctttttaatttggcaatgctaacagctacagaagacatattaccaccaaccaaccgttgcttcattagaaactgcaccaaatccaatgtcaaaaacattactttatttttctagtatgaaatgtcctattacatacaaaagaattgctgtttagaatttgccacaatttgttgaaaacatagcaatctattgcctacaggtaggaaagttcttgctgcaacaaattttaaatgattaagcccatatatatttctatatatatgaataaatagtgcagaaatactgtgacgtgatgagatgcagaataattttataattcattaaaatgtagaattcttgcatcagcacagtgcatacaatatgtaactttttttaaaaagtaaaaggacaaaataatccatatttaagtatttccatcttaatattttaagcaaaaatgttttcatgttttcatattgagtgattagtctctttagtttgtaaacataggtttaagtgacatcttcatgtacaaaaaggaatgggcttcattagataaaattaagccagaataacctgtacacctgagcctgtaataagaaagaattgggaactgtagcaacatctttcttttaagaaaccaaggtctgggaaaggttttgcatagcagggaaacgttgaaaggaaggaaacttttaaaagcaataattagataaattccagaagttgataggacaaagctaatatgagttagaataaaatctagtagaatttttgcaaagctgcataatccagctatggcagattttatagaagctattaccacaatgcagtaatacaatgtgtaagaacattgaaaggaagaacatgcaaaatacatcttcctcattttcttcctactgcttacactacttttccttacatggaagaaacaaacaaaccaacaagcaaaaaacaaacccaatcaacaaataacacagaggatgagatcatctaacaaaaaatgtccttcatacaatataagtagctgtctgtaattggtaatttgcccagtatcacagaatgtacagatgaaggcaatgtgtatcttgtcgcattacctttttcgttagtatgatcaactgatgcgacaggattagcacccctgaagattcttctctgacgtgatgacaattgactgggaatgataaaacgaggggccactgctgtccaggagaattccaggtacaattagattcttttgcctttcatgaccttgcagccctccctccccacagaggcttacagataatcattagcacacattcaaagacacctctgtctgtgggagaaaaactatctccatttattttgtttcacatacatccatagttgaattttaatacaaaaagaaaaattagaatctgacaaatgtttacaaagaagataccttcaaatagattttactcatttcaacctggtgtggagtaattgacaaattgtactgttatattcaagtcaccagagtctgtagtccaggaccacttagcccaacctttatgcaagcttgattttaatctaccatgaacaataaactcattgttgattcgcagttgtgtgtgtgtgcacatgtgtacatagcagctcctttcatagaaagaaaagacatctagaggttgtcttgtacttttacgtacaggaatcattgataagatatggatggattatatgtaaccgtggctggattttataagaaaaaataattagttgacaaatgagggcagcaataaaaaagcatcttttttgcaacaataaataaatacagtcaaaagttttctttgagactctaaaccagcttcttcactgaagagcagacgtggcatttccatggagttatacttgaccccacagtatcattgtttcttgctttctttttcttttttttttttaataaacaaaattttctcgcttctgccacaataataaaaccatttgatcttgacaagataatggtgtcgttgacttttcttttttctttttcttttcttcctttttttgtttttgaaacggagttttgttcttgtcacccaggctggagtgcaatggctcaatctcggctcaatacaacctctgcctcccgggttccagcgattctcctgcctcagcctcccaagtagctgggattacaggcataggccaccatgcacagctaattttgtatttttggtagagacggggtttctccatattggtcaggctggtctcgaactcccgacctcagatgatccgcccgccttggcctcccaaagtgctgggattacaggcgtgagccaccgcacctggcaactttgcttttttcttgtccattggacaaaattggccaataatataattggactgttatgaccaataaaaacaaagtttaggtcaagtcttgtcaggatagcctcactaaaaagatctggctccttaatttaaaatagttcaggcaacaagattcttgctgtgttttatgttaggttaacatgctgaactttaggaagctgtagactgcagtttgttgttgtgagacctacagagtatagaaaaagggaacaattgagcacctttcatttttgaaaatgatgctttatgcggatgccaaagtaaataaatctggaagaagcagccatgttctttcattcacccttggcaagcgaatagaaaagaacgattaagaaatttttaacctataataataaaacttttcactgtacactaagcataatagctcactggaaaaagccaatatttaaaatatgtatgtatatatatttgtctaataaagattacaacattttcaggcaactggacaaatagagacatttacagaagcattaccattgtggtgaaaggtgcgtgtgtgtgtgtatgtgtgtgtttatttacacggatgaggggaatataaagggaaaaattatgctaaaacaaaagaaaaagcaattttaaaatcatatttttctattaaagtccagaaagtctcccagtttcacacagttttattcacaattttttttttttttgagacgaagtctcgcttttgtccccaggctgtagtgcaaaggcgcgatcttggctcactgcaacctctgcctcccagattcaagcgattctcctgcctcagcctcccgagtagctgggattacaggtgcctgccaccacacccggctaatttttgtactttttgtagagacgaggtttcaccatgttggccaggctggtcgcaaactcctgacctcaggtgatccgcccgcctcggcctcccaaagtgctgggattacaagtgtgagccaccaaggctggcctcacaacttttgtcagtaaaccaaattactgtacagttaccaggactaagtcaaaggactttatattgcaatagcagataaatttatattgcaatagcagataaatacagtattccaatagtttacaatttttaaatacattgtttcacgtggctgctagaataaattttttaccactatacatcgttaacattaaaaaattatattagctaacctgactttttggggggcaattttggattacgtaatcacaaggtacaataaaacagtgaccccaacatccagttctgattccagttaaaaatttagactaaagatatcacaatccgtaagaaaagaaagaatatggatggtataaatgatgaattataacaaagtgcagtaatgaaaacaatgtgcaaacaatgctggagatcataaattacaatgggaaaatatggcaaaggaaattctggaaacccataataaaatcaagtttcaataactggctagttatgtttcattctaccttaaatctggaaagcaatagaaattccctaaaaatgcaacagcaagttgtctttatacaattctttgcattgtaatttttttctttttttctttttttttttttttttgatttgtttgttttgagacagggtctcactctgtagcccagtctggagtgcagtggcacaatcatggctcactgcagcctcaacctccagggctcaggtgatcctcctacctcagcctcctgggtagctgggactacaggcacgtgccaccatgctcagctaattttttgtattttttgtagagatggggtttccccatgttgcccaggctggtctcaaactcctgggctcaagtgagctgcctgccttggcttctcaaagtgttgagatcacaggtgtgagccactgcacacagcctaatttgtttatttaagcagaattgagcaaacgtctccattcagctcccatgtgctttattgaaaattatgtcaacttcagtatattaaaaagctacataaaataaccaggtggcaagaagacatcctaagtggcccctacactatgcgggcc

SEQ ID NO: 24 - DNA, 205569 bp, Homo sapiens
actgcagtggtttacatcattagtgtttttagaaaactaaagcatgactgagatatctgctatccaataggcaactgcaaaaaggatgaaagaacttaagactctcctacctagaaaataaggattatcactgaagcttccatttgaattttatttgatgttgagatgaactcagggtttatgcatcccacagccagaaagaaagagtagaaaagctaaagtggtagacagagtgcctctgtaatcccctcctctccaaagcagggccctaggggattatcttttggagtaatcttacagttaaaggtagcaaggagggttgctgaattgctccccccacccctccccccgccccgattgaaagggccaggtgtacagcataaaattactaacatagcaatgagattcaaatttgttattcacataaagcaggcatctcattcattactccactctgggccagatcaagtaagcgtgacaaagaggccttgaatgaaaagctaaaactaaatagtttttacgggggtcgttttttctagggtctaagaaccaatgtctactagatttgtttcaccaaaaagtagagagggttaaggggtaaaaacagagagccacacacttaaaagcacacaataaaattaaactctacctgcaaatatgtatttttactttattcaattaatgccatgtcacacctgcttgcaatgtcattttttaaatgtatcacattcgtttggctagaaaagtcaacagttcagttttggttagttattccctttctgacaaacattaaaatggaaagaaaatgctaactgggtgacaggaatttaacttattcctgggttaaaatagtttttgactttgtatgattgatttcatgtctcaagcccaccccacccccatttcaatgatactgagcatagtttcgcttaaattcaccaaaatattgctggcctataaatagtatactagccatttccattagctagcaccatggccataaaattgtactaaacaagaagtggaatgttctgaaaattccattttcactaagttattgcctaggctttaatttctgcctatgtggggctatgtgcctcactttccggcttctgcaggttgaggataaaagaaaatctataaaattacattataacaattttgaactcatttttttaaagttttgattagcataatgctgttactaatccaatggttcctaagcctaagatttatgtttaccaacacttgaaaataactatctagaatttaaagaaatatagcaaatgcaaaaatgcatcttaaattcttattgttcaacttatttatccatagcccaatttattataaaagacctaacttgtcagtgttttctaacactgtgggtcaaatatttcttggccaatatctgtccctttaccttctatcccaaaacccttgtcaggccaatgaactactcactgtccctagagactgcaaaacttcaaagaaaggaagagtattcctacttacaccaatggaatgaagatgtatcttggactgtgtaaaaagaaacagcaatagcttacatttttagcatgcctttcttctgagaaagcattagctcttcacttaatagtacacttgtttttctcatcacttctgtaaagtaggatgagcaaggaaagggtaaaggagcaggatcattttacaaacagaaactaacacacaaataatgtgttacttgttaattgccatagaagcaatgtttttcgctaaacaaaaccctccttaacgtcaaatctagtattttaaaaaatatttatccaagaaggagattttaaaaaatatatacatgtgtctgctcatcggtgcaaaaaaatacaggaaagataagccaaaacgtactgaaattgctaacctacaggacgttgagtgagaaaaggatataaagaagaatgtatagcttttttagaaccacagtaatgtttcccatacaaaaataaaaattaacaatgcggggtggggaaaacagggaaggctagaattgaatactgtagtaacaaatgaacctaactgtattacaaaacaacataaccatactgaaagatttggtggaaggaaataactaacctacgtaacttcagaaaactgtattttgactgcataacagttaacatactgtacaaaaatattgtactctagttagcaaatgtgtttttcacaggggtactagatgacaactgtgagactatacgggtactaggattaaacgagtatcaataaggaagggggaaggctgctgtgttgaactggtatgaacttacggttttttatatatatatacaggttaagtagatacagaaatatagatgtgtgtgtatgcacctgtgagcatagatacatatgtttccttgctttgccttttgagacatcctagaagcagtgacacttacgaagtaacaatgagcacaactagtactcagattttagttcctaataaaaggaacctgagctgaagtaggcaaaatacaagaggaacctggaacatctagtattagaaagtatttcaaaatataagcggtacatgctaaaaggacacaggagccaatctgaaagagcgcccaatacccaaagttgagataactggagcaactgtataaacagtaataggttataatccattaaataaaataaatatccatgggaccatcctgatattcacaactgagtcaatgaatgagtaaataaatgaggggggaagacacctcttcctaacagaattccatttaatgcaggtaggaagtagaacaaccaccctttagtaaacaacacagcaataattgctgtaggaaaaagtcatcagtgaacaataaaattatgagtaaaaatataatgagcaacagaatatttacatagtgtctccctataagacagtcatttattccagccagggcaaaatggcaaaaccttgtcactacaaaaaacataaaaatgtgccaggcatggtggcacatgcctgtgatcccagctacttgggaggctgagagatgggaggatagctgagccagggaggtgaaggctggagtggtgattgcgacactgcactccagcctgggtgacaaagtgagaccctatctctaaataaataaataaataaataaataaataaataaataaatattgtcagttattacaaagggaaaaatgctaattttacagaggagaaagctgtcaggcaccaccttaaccaagggaacaaacctatcatcactattagaaagacaagtcaaaatcatgaaccccctgtggtgtagagaagggtacagtatcttctgtggcattcctgtaaaacaatgcgtaacctctaataatgagaaaacaccaatttgtggaacgctatacaaaataactgaccagaaatcttgtatccaagtaatgaaatacaaaaactgagaactctcacatattgaaggacatttagagatgcaaaaactaaaagcaatgatagattctggacaacagaaaggacattaataagaaaactaataatacagaaattcaaataaagtatgtctattactttgtataagttcaatgttaatttcaatgttaatttcgtggttctgataattaacgattattgtgacaagatgtgttaagattagagaaagctccgtacggagactctgtactactatttcaacacacacacactctctctttctttctgacacaatctcgctgttgaccaggctggaatgcagtggcacaatcttggctcattgcaacctctgcctcctgggttcaagtgattcttgtgcctcagcctcccgagtagctgggattacaggcgcacaccaccacacctggctaatttttgtatttttagtagagacggggtttcaccatgttggccaggctggtctcaaatttctgtcctcaggtgatctgcccacctctgcctcccaaagtgctgggattttaggtcaccgtgcccagcctaaaatcatattttaaaagaatgaagaaaaaatgtatctagcattaataaaacaaacttcattcatacataaatctgtacagtctacaggttcctatcagttacagtactcacttaagataaatatagaatccattctgaattggccaaaatatccaacactccatcacagaaaagtatttgcagttacctgataatgccaggctctttcaagcctatgctgcattacacattactccctacaccatgcttcagcaagtccataagactcagaaaaaagtccatccttccctaggaaactacctttactgactccctccagcactcccattttatgcttgttggaagaacaagaagcactcaagaaaagatagatacctggttctacttagtctttcagacacaaagtgcagtctggaacaatgacaattagcttttactaactttcattatctatcaaacattgttaaaagcaaattataaattttaaattaactttgtaagaaggctagaaatcaggtagtaggaggagagtgtgactcctccaatttggttcttgtttttaaaaattgttttggctactggccaggtgcagtggctcacgcctgtaatcccagcactttgggaggccgaggcaggcggatcacttgaggtcaggagttcaagactagcctggccaacatggtgaaacccccgtctccactaaaaatacaaaaactagctgggtgtggtggcacacgcctgtaatcccagctactcgggaggctgaggcagaagaatcacttgaacccaggaggtggaggttgcagtgagcccagatcacaccacagaactccagcccgagtgacagggagagacttcatctcaaaaaaaaaaaaaaaaaaaattgttttggctcttgaaaatacttaacatttccatacatacttgaaaatcaatgttcaattgttaccaaaaacaacacaacataaaccaaaaaatcttgctgggatttttcactgggtttgcattgaatcattgtgtctaacattgactcttctaacacataaatacagcatacatctccgttcacttatgtaatctttttcagaagttttatggtttcagcaataaagtcattaacgtcttttgttagatttattcctaagtattttatgtttcttgatactaccgcaaatggaactgtttctccgggttatttttcagttgtttgctctaataaataaaaatagaattgacttttatatattgaccccgtacctggagaccttggctaaatctctaattctcacaggtttagggaattccatggggtttctaagtatcatatcttcaaatacaagcagttttgccctaccttttccaatttccatgcctttaattgcttttttcttgcaatattgcattagccaagacagagtacaatgtttttgtttgtttgaggcagggtctcaccccgtcgcccaggctcaagtacagtagcatgatctcagctcagtgcaacctccaccacctgggctcaagcaattctcccacctcagcttccagagtagtgaggactacaggtgcacgcccccacaccaggctcatttttgtatttttttgtagagatggggtttcgtcaggttgctggagctggtcttgaactctgaggctcaagcgacccgcccaccttggcctcccagagtgctgggattacaggcatgagccactgtgcccagcttacaatatttttaggatatatttttttcctaattgtagaccaacaaaacaagcactttcaccaagtagtgtgatgttaggcgttaggtttttttcctaatttttaaacagcatcacagctcaggaataaggtcttcacctttgattttcacgatttttactacaatgttgtgattctcatggttattattcttgaagtttcatgatttttttattttatttttgagacggagtctcactctgttgcccaggctgcagtgcagtgccatgatctcggctcactgcaacctctgtctcctgagttcaagcgattctcctgcttcagcctcccgagtagctgggattacaggtgtctgccaccacgcttggataatttttgtatttttagtagagatagggtttcaccatgttggccagactggtctcaaacttctgacctcaggtgatccacccacctcggcctcccaaagtactgggattacaggcatgagccaccgtgctcggcctaaagtttcatacatttgtaaactgactgtttaaattcaaaaatccagtcattaagttcctcaatttttttccatctttttttttctttttcctcatgactaagaatcatattctcatgtttattcatatgtatggtaattttctattatatacagacaatgtatgcaatacattatagagactctgaatttagttagcttttcctaaagagtgttgatttttgttctagcaggcatactactactacctggttaccttcattttgtggagctagttttgtttttataaaagcatagtggagtctattttggttccctccttaatcctatggtgaatgccttcgtcctgggaaacattctttaactctttaagtgtgagcctttattggtttcaatcaaagccctcaggtttttgccaagtctagttggaattcgaactccaaattctgccttccctgcattaggcaatgatgatcttctctgctcagctctttcagccttccaattactgctttccactatgccctataaaatcttccctaaacatgtgcaggtcaggggtgagcacaaagatctgaaaggggctcaaatagattgtgggcctatgcccctccccatctcccatagctccctctttgccactattcccctccttcaatttctacctaacttggcagccctgaactccatcctctgataatatacaaacaagcccatgaagcagtgactattgaattctagaagctctggggcacatggactgagaatgctctcatctcttcctggcaatactttctgtctgaaattttgctgacattgttgagtaatttacctagtaatatgcacaggttccaagcttgcccttctttgctcattactttttcttaagcaggggaaagcaagcttctatttgaagagagagaatgagaaggtggggaagataagaggcatgtttcaatacactagagaacaactctcaaccgctttttacatgctctctttccaagggcacaccctctttgttcaaaaggagtcttaaatttcacagaagcatttatctgtacacacgacttatcggcagctaccaagctagaggcccgttaagttttctctccctcagctagccttacacctttaaaactgcctttgagtcagaagtcagaatgaagaggttaaaataaaaaaagaggcatttttctaggcattcctccttaggtcttccctttctctaacccactactctgtggtataaaaacagtacccacttccctaacccagaaaatattccttgatttgctccatgactcaaaaaaggttcacccatgaattcagtctccagttcttttgctcataggttgggtccttttagaacaacttagttcaataatatctgtactgtattcaagacccaagcagatatatactggttctgtcaataaacaatcatcctgtttggaaataaagcaaaaagactatgtatccttgcagtgtaccactgggacattacctaacaagcccacccaggaaacatctgactctccataaattatttaactttgttttacctactatctataattgattagggcccagaagtcttactggatgtttattttagaacgctgacaagttaaagttggtttgcatcttgttgaaaacaatgtccaaagttacagctttattgttctataggatattaataacttttgtatgctactgagtaatcatattcctgcattcttcctttttatctggtattaaaatactgttaacagtttggccaccatcatgattcccttgttattcagtaaatcactatatatttaggaattatgtctaggctggtgcagtggttcacacctgtaatcccagcagttttggaggccaaggccagcggattgcttgtgctgaggagtttgagaccagcctgggcaacttggtaaaaccccatctctacaaacaatacaaaaattagccagacatggtggcacatgcctgtagtcccagctacttgggaagctgaggtgggaggatcacttgaacctgagaggtagaggctgcagtgagccaaggtcgcaccactgcactccagcctgggtgacagaataagaccctgtctaaaaagatggaaagaaagagagaaaaagaagagagaggggagagagagacagagagagagagaaagaaaaagaaaagaattatatctaatgttttgaaactatattttgacaattctaaagacgctgatttttttgttaattccagctgagtttcagaaatgagaataaaaaaattaaacataacagaaaatacctctgacattattatttttaaactacaagtcttcaaatatatttttgggtaataaacaagcacagtccaggagtttgaggctgaagtgagctatgattgtgcgattacactccagcctgggtgacagagcaagagcctgtcttaaaaaaaaaaaaaaaaaaaaaaaaggaataaatacacctacctccatttggggaaaaaattaacaaaatggaaaacaggctggttacatgtgggtatgaaaacctacagttgccctctgtcccgggcaacctaatttttttttttaagcaaaactgagaaaagtcactttcctaaaatttaaaacaaaacaaaacaaaaaaacctggggaacaaacaagcaaagttaaatactgccttcttatacagaaaaactttgcctggcaattgacatacgcacagctttgcaaatatttggcattttaaaaatttaagtcaatagcttttaagaaacatatgctctgcgcccattctactaataataaacaatggaaatgtattgtccctgctccccccaccccaccccccaacccctgtcttctcttaatactttctgaacgcttttcagaaagcatggatatattcataaagggtagataattcacgaaaacagggaaggggtaatctctccttgacaaaatagtgacagtgtatacttagttgttttcattatttattttactcaatccaaaaagcattctattgcacaatgttgaaactagtatggccaacacaaagggaaagatggtcttgaccttcaagaatcttacaatttaatacacacacaggaatcttacaatttaacacacaagtaaatgaatgaagggtagggaaaggaccaagctcctaaagagtgtgtgtgtacaagtgaatctgtataaactgtctcacaatcactgtggattttttaagacaatgaggattagtaacacaatggaggactgttatgccctgtccttcagaagtgctgaggtaagagaaaacatgactacagggagattactcaaaaaagtttggaatccctaaattctatatacaaatatataagtatctacatagaacttactcccctatcacatatgcctcatgtttcatgtttcctgtacccataccaccaatgtatctatgtttcctttctcacttaacaatttttaccctgattagaccattcactaaaagtttcattaataacttaaaaaagatctgtaaacagcatgcaatgaacttatattatagacttaaatagtggcaaaacttggcattctgctctttaatttattcaaaactactttccagttaagaactatcaatcttctagtgtcttcacatttatctctagcaacagtggctggctttcaaaattaggtgagagatctttccaagatctaaacatctccaatatctgcctcagagaaaatttagtttccaccacatcatgcgttcctgctaacaatgattaaaataaataaaagaactataaggttggtttatttgcggatacaagaacagcttgcttaactcaccatttaaaaagccatcacttcacactagctttattatctgaagcataatcaaaataataaactacggttgtgggactttggaatttctaattaagttatggagacttaaatcaagaaatatgaatattcataaaacccagtaaccttttaggcaaagtaaaaaagtgaaaagaacaagtgctcttggaattcagaaagaaaattaactatggtattgagagaaaccaggaaagagaaggaatcacagtagagctaggatacagaaggaaacagaaaatgacagtttaatgctcattatagaataacagtgaatcacccacagagaccattttcagtgttcttgtgaatttaacctctagtctaaccttttaatgaaaaggctataatatattagagtggcccagaaaggtgaccttatgtctcaggtgtcagagccacacccaggtctcctgattcccaatgatactccctaaagccttacttgctctggctgtagtgttttgagaattggagctgcttttaatcctatggtcagctacacagctgcaggatgggccctagattccctattcaggaattcagatcttaaaacaccaaaagtgataaaagtagatacagttccccttcttcagccaatgcaaggatcctagttacagagaaaaaacggtgtgccaagacaacacccttaattctcacgcatttccccctttctatcttttatacttaccaatttatcagtcccatgatctgtcttcacctcagaactaagtggaagaaataagtctgttgtatgctctgggggaggtacctccccaagaactatcaacccctgcaggatagagaggagaaaaatagcataagtgagcagtataaacttcaaatttaatttaggagttaagtctcaaaaggactgttggtgtactagaggccccctcttcctcaccctatggttcagaaacaaactacagcagcagcagctttgttttcccaaagagctatttcaacaagcagcagacccaggctcccctctctgccacttgactgctctgacctacatggctcatcagccatttagcatctttattcatatctttcagatatgaaatctttaccagattatggcatttataccatattactagactccactagattaacagcagcaatgcagtttttgtagccaacaaatgcagtttatgacttactaagctgaaaatgctactattcttaatcatgtactccaccaactatacctgcacaaacaaaactgaatgaaacaaatgtggaacagtcccctacaatttatgagaaaccaagagcttcttaaaagctggcccaaaggaacctgcttttttcataagcataaatattacttcagattaagttcctgcttgacaatttcaaattcagacctttggaaattcattccaggaaacaatttacataaaaagaaattaaaaatgaacccacaagtcctccccattgtacatataatgagccaggatgggtaaaggcagaaggtatcttattattaaaaaaacaaaatactacatatgaatcccaccatgtataccagaagaggtgacaaaaataaggctatgacactatataaccgaaagactgggatgcaagtgatcagggttcccaatctctttctctggtctaaaaaatagagatctaactagattaagaagctcttaatggaaatttattatcagaatcacctggggaaccttatcaaactatactggcttaggtccaacatctactcagtacctctgggggtggggccaggtagtctacctttttatgggggaagggaggcaggacatggtgggtacatggaggtgggtgtctctctcctcccccaccccgccaaccccactatgttaccgaggctgatctcaaactcctgggctccagcaatcctcccacctcagcctctggagtagctgggatgacaggtgcctaccaccatgcccagaggtggatattctactattctttaaaagctcccctggtaagtcctaaacttgtaaagttgaaaaacactagacttgattagtttgggctcaaagaacatcctaaagtatagatttgggggactagggattgtgactattagtcttagctctctaggccatacgacagactcttatgagccactaaaccagatgatccatccctggggtccttgtaactaaaaaaccaatatgaaatacaagctgcagaaaaggggaaaacattaagaaagaaaaatggaattttatttcagtttttaaaaaagaagtatgtatctctttttctcttgaagcaaaagaagcactgcctccctattctggaatatgactacacttagcctgtatcaaaaatgaattggagggtcccggaatggcggctcacacctgtaatcccagcactttgggaagctgaggcgggtggatcacctgaggtcgtcaggagttcaagatcagcctggccaacatggtgaaaccccatctctactaaaaatacaaaaattgcccaggcgtcgtggcacatgcccatagtcccagctactcggaaggctgaagaaggagaatcgcttgaactcaggaggcagaggttgcaatgagccaagatcacaccattgcacaccagcctgggcgacagaccaaggctctatctccaacaacaacaacaacaacaacaaaaatgaattggaggctgggtgtggtagatcacacctgtaatcctagcacttggggaggttgaggttaggagtgcgagaccagcctggccgacacagtgaaacaacgtctccagtaaaaatacaaaaaatagctgggcgtggtggtgagcccctgtaatcccagctacttgggaggctgaggcaggagaatcgcttgaacctgggaggtgtaggttgcagtgagccaagactgtgccattgcactccagtctgggcaacgagagcgaaactccacctcaaaattttaaaaattaaaaaaaaaaaaaaaaaaaaaaaaaagaattggagtctcctcagaaacaagagaaaggccattaactagtaagcaagaaacattaaccctagcctttaaaatgaggtttctctggttaaagaacttctgcttcaaaatattttcttccctaaatcaaaagcataaaatataccttacaaactttatcacatccaaataaaaactatttgcaaaagacagttatcttgtacaccactgccttctcaaaacgttgtattcaacagatattccctacttaagggcccaaactgtcttcctgcttcctgtacaaagcatgccaaaaatcattttattattcaaattttcccataaccggttcctaagaacttttttaaagatcaatttccaactactttccccaaatatttgttagtgttataccaatctcatcatctcctagacaaatgtttcaatgaatgtgaagctgttgctgctgctggaggtaagggttattagtcagtagaaggttaaaaaaaactgaattaaaggttaacacatgagctgttcatctttatttatactcatttttatattttatcagtccaaattgccgttcgtccttccaaagagattttcaacaagtcccacctccttccaagaaaatgtcccgggttaatgagttcctacttgctttatccacactgccagacctcctaaagcacggtgattgtatcttactttctgtgtatttaaatctcatttccagagcattcataatcttatgccacattatttatttcacttattattgcctcagtttcttgtttgttgagacagggtcaagctctgtcacctgtgctggagtgcagtggtgtggtcacgaatcactgtaacctccccctcccgggctcaagtgatcctcccacctcaaccccataaatagctgggataacaggtgcatgccaccacatccagctaatttttgtatttttttggtagagatggggtttcaccaagttgctcaggctggtctcgaactcttggactcaagtaatgcacttgcctcaaactcccaaagtgctgggataacaggtgcaagccaccacacccagctaattgttctattttttggtagagatggactttcaccatgttgccaaggctcgtctcaaactcctagactcaagcaatccacctgcctcggcctctcaaagtgctgggattacatgtgcaagccgctgcacccagcctttaattgttaactaatgttagtttattgaagatgtggacaaaatacaaatatatttaaatgacccatgtcccttagcagagtcatacaccaagaaaataaatgcatagcaaatatttgttgagttgtataatttttttcctaacaggaaaatattaactttataataattatagccagaagataaataaatctaacaattagatataaaattactccttcaatttttctttttcagttatatgaaagtaaggacgcagtcagtattttccaaagggaagaatttttccttaaactacagaataatttctaaatacaaccctcagatagattatgaagacatctcctaagagagtataataaaacttggtagggaccatctattcatcgacataattttatagacccacagaggatgtaggtcaaagcttatgtctctacaggccaatacatggcagaactggggcaaaagtctgcatctaactaatatttcattcctcttttgttcagttaattcaatcatttatccgctcatcagcatttgttaggtactaaggatacaagaaaaaatgagagacctatccctctcccctaacccatccttcaaagtgcttattacgttctaatactgcggcaaagaaaaacaatgtaaataggtaaatgttatgtactacattagaaggtattaaatgctagagagaacaaaatataggatagtgaggggattaagaagtggaaatggtggggttggtcgtgacggctcatgcctgtaattccagcactttgggaagccaatggaggaggactgcttgaggccaggagttcaggaccagcctgggcgacgtggcaaaaccctgtctccacaaaaacaataataataaaaattagcctggtgtaatatcacacctgtagttccagatattcaggaggatcacttaagcccaggagagagagagagatacaagtgggagggggtactacaggcgcataccaccacgcctggctagttttttgtatttttagtagagaaggggtttcaccatgttgccaaggctggttgcaaactcttggggccaagagatctacccgccctggcctcccaaagtgccgggttgcaggcatgagccactgtgcccctgcttgaatgtttatttgaagacagaatcaaccagctatgccaatgtgcttacaagataggagggaaaagagtcagagacactgccaaggtttctagcttccacaaccagaagaatggaactcttcttcatttgttcagaggacatttgaatacacattagttttaattaaacctatttttgaaaatatgtgctcaagtgttacactgaagcaaccaacaatcatccatacactgtccattgcccccaagatatgtaagttcactatggcattcaaaaccaaacactggatcctctaatttaatactgtacctcacaccaaaaaggatgaaaacagctaaaaagaggctgagcaaataaaaagcatccaagtaggtaagagtcattcatgcaggtagcatctattgagtggctaccacgtgcaaggtagtgtgaaaacacagtaataaaataaaaacagattctaccataaggagcttatgttcatctagccttgaacagacaaagagacaaagtattatgacagtactataacagaagttgagagaaggtgatgtcagagcagaaaagagcctaactgaagagactgatgaaagtgaggctttacagaggaggtctacataattacttaacattccccaaaatatatttaatatattttgagctatacttattcattaactatacacttaatgactttgcccttttctgtatacaatgtttcatatgccacaataacacttatttcggataaagtttactcatgtttaataaccatgaaaagaaaggttagcattagctgagaaaacttcataatgttctactccacacctgtcatgctaccccaacatgggcttccctaacattccaggtttaaactgggtcagtgttgaatagctgtgccattagcctggtggcaataaacttagggctgctgtactatgaaatagcaaccggtagaagccgaagaaaaaggtcaagagtctccttttccttcgccatgtcccgagtcagagccaggatcatgcttaggctgcacaggcctagaaaactccaagagtgaagcaagcttctgctttacacaaggaccaaaggaactggaatgggtcacagttacatgcagccttaatacctcctaagtgactcctctgtggatgaaccctctctcaactgtatttgcaatacagctaacaggcaatttcacatacttccttacatcactctatcaggtcaatcttccctatgcatctcaagacaaaccagtgaccccactgcagaccagttccacaagaatcaccctgggctacctggaaaagataagttgtctaaagtgctttaaaaaaccctattaagatgagaacttcaacagctttatgaaaattttgaagagaaaggtgttataagcttctgcagttcccattcaactccttccctattcaaaagtttcaatgctcttccacctcccatcctcaataacatttccatcctcagctacagctgtgtaatctcaaagagtagtcagaagaggagattttaaaaaacaacgtaagagtcaagccagtgcttctgggaggccaaggcaaggaggatcacttgaggtcaagagtttgagaccagcctggacaacacagcgagaccccatcctttaaaataaaaaaaaccctttaacaattagctaagcatggtgggacttgcctatggtcccagctacttgtacttgcaaggctaaggtaggaggatagcttgagcccaggagtttcaggttacaaagaactatgatctggccattgcacctcagcctgggcaacagagcaagaccctgcctcttaaaaactgcttagtccctattctttcccctcatttaccaggtgtgaaatttcaacaaacatgtttcagtgaaatgatgaaaaggacacaacagcaaagtatgttagaaaaaaaatgctttggaatcagataaaaagtcctgagtttaaatttagctctgccttttacaagcctctgaagatttattctgatcattaaacgaacatacatgagtaaacctttaattagtatacactcaaggtacgtatattgttttcgtttctccttctaaagcatggaagagtttctttttaaaaaacaagctgacaaactatgaaaattaaaagagtacaacagcatgcagaagtagtacagaggagttcctagaagttatattctttctccagagagcaatattattcccaaaagggactctactcacttcacagcttggaaggtaatacctaccttctgacagaacagaaactggtgtctggatcctagaatcacctagcagtagtcacaaatactttttttttttttggtaatacgccacttaaataaaattaatgttaataagcaacaaagtaaatccttaaaaagaaaagccccaccatccctccaatctcccacccgaagacaaattataactcaacagcctatcaccaagattcagcctatcacctaggttcatctcaaaaaaaaaaaaaagacctgtgcaacccaggaagtgctgggaaatcttggtgcagcatggaaaatatgaacaccaacccacttaaccaaaacacataggaaaaactttcttccatttcagtaactaaaaaaaaaacccaagcacttaaagtgattactaacttgagcaatagctctgcactcacttggatgtgtaaccatgaacaaactacttgactgctctgatcttccattgtttatcttgaaaatcgtgaatgagagtaaaatgcttagcacagtgcctgacatatcacaagtgctcaaaaacttctattaattatagtgttacataaagactaaatgcatgtgaatatatcattgggggaaaattccatggcttgttagagcaagttgaatattgtctcttccaaatttatgttcacccagaacctgtgactatgaccttgtttagaaaaagggtctttgcagatgtaatcaagttatgaagagccatttagtgtgggctctaaattcaatatgactggtgtcctcctgacatggaaatctacacagatgcaaagagaaagatggtcatatgaagatggaggcagcaactgcagtgatgtagctacaggccaagaacaccaaggactagcacaatatcagaagctggaaaaagacaaggaaggattcttccctagagcctccatagagaccatggcccttttgacaccataatttcagacttctggcctccagaacggtgagagaacacatttctgattttttaagccatcccatttgtgatagtttgttatgacagtctaggaaactaatccatttgttgaaaaagaaatgtataaatacgacacgtaaagctgtgaattttcttgatgcattacttattggaactatcaacctagttttattcttcctatcggaactctgagaagtaaaagattatctatgatgttgtattttacagaccaagaatctgaagctcagaaatgttaagtgacttttcttctcaaggttcatgtaagcagctggtagcaaagccacgattagaaacaaaaatttaccaagtccaagtatggtgcttaatacaatacgctttgaatgatgaaactcttggataagcaacatacattcatgtgccaaatagcattatggtcaatgacagaccacatatacaatgatggtcttataagattttaatacagctgaagaatacctgttttagcacaaagcactactcctgtgtttgtggtgatgctggtgtaaagaaacctacagtgctgctattagaagtataccacatacaattatgtacactaagaatataatagctgataataaaagctatgttactgttacacttatttcttatgataataaaaagtgttatgtatttactatactatacttttaatcgttattttagagagtacttctactcattaaaagaagtgaactgtgaaacagcctccagcaggtccttctgttggcactgtcacaggcaatgaaagctccgtgtgtgttgttggccctgaaaacctaacagtgtaacaagatgtgaaggtggaagacagtaataccgacaaacctgaccccatgtgggcctacgttcatgtgtgtgtttgtgtcttagtttttagcaaaacagtttaaaaaataaaactttcattttaaaatggaaagttttaaagatagaaaaaagcttgtagaataaggtgtgaagaaaatatttttgtacaattacaatgtatttgtgttttaggctaagtgttattacaaaagagtcaaaaagttttaaaaacttaaaagtttataaagcaaaaagttatagtaagctaaggttaatttattattgaaaaaaatatttaaaataaatgtagtgtagcctcggtgtacagtatttataaagtttatagtagtgtacagtcatgtcccaggcttttcaatttcagttacccttcacccaccgactcacccagagcaacttccagtcctgcaagctccattcatggtaagtgccctatacaggtgtaccatttttatcttttctactacatttttactgtattttttctatgtttaggtatgtttaaatacataaatctttaccactaattgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatatgagacagagactcgctctgctttgcccaggctggagtgcagtgtcgcgatctcagctcactgcaccctgtctcccaggttcaagtgattctcctgtctcagcctcccgagtagctgggattacaggcacccgccaccacacctggctaatttttttgtatttttcatagagacaggggtttcaccatgttggccaggctagtctcgaactcctcacctcaggtgacccacccaccttggactcccatgcctcggcctcccaaagtgctgagattacaggcgtgagccactgcgcacggccctcagcttgaatttaagtgcactttatgatgttcacgcaccaatgaaatcacctaacaacacatttctcagtttcccttttgttaagcaatgtgtgatggtatatacaaaactccagattattttccagatatttagaaatacttttcagatattttgatattttgaaagtttctgaaaattgctctgtcattacttctgagtgatgagctgaagaataaagcatgaaccaaatgaggtgagtatcttcttatacacagctagtgagactataaactgacactgccaaaatacttctctgaagaatgcattaagaacataaaagagcattcatacctttgactgagataaagatatttatcatggcatatttaatttaaataacaaatgtaacttaaatagtcaacaaagaaagccaatagcatgcagccattaaaaatgttttccaaaaaccaactgggaaatattcagggcacatacgtaacatgactgtatttgaacaaattacttatgtgctaggaaaatgtaccataatgttggtagcgagataattttgagctgttgggttgttttttttttttttggggggggggggagggtgggtgtcttttatacttctatgtcatttcagtttcctgagaattgatacacagtatttcatcaattctaagaggtactctccccacatgtcaacaacttttaaatcaagatgcattttacaatttctgttatgccctggtttaactgaaataatttctttgtcgtacttaaaacaatggtacatcttacaatcaatagcatcttaagttctatgaaatgtagcagttttataacaaggaactaagatgatataacatatacacatatataaacccacatatatatttatgaatgtatataaaaagatgaagcagcacttatgactactattatactaatctcagttgttactaagagactctagttctcaaatatagaaaatcccacttaactactggctataaaaacctagaaacagacactgaagaggtgtctctgatagagaaagactgtgtttttctcctcagtacaggcatatccagtcacctcctagttattcttagtcatcattccagttcaagttctacaaatctcactttaaaatttcctttgtgaagacttgggaaagcaaaatatgcaccaaatctagaatgtttattagttttgttccagctaatttttaaataagtaaatcaggatttaatttgtatgctaccctaagggaacaaactagtaagaataaaaaagtgagccctctggactgtgtcctcaattaaagtatgctctattgaacttttagggggagggggaatatatatatatatatgtatctccaatctggaaagaagctataagtccgcagtgacatttttagaataaaagtttaaatgattagatagcccacagaactttcacttcaaaccctgatcattctgttcattttatcagttgatcaaccttcaacttttggcctactaatttaatggatactgttcacaggaaagccattttcttaaggctttgactagtactaaggtcaaaaaggcattttgacccttatttttagtagcaatagactttttctagacatgggtctacataaagatagagctcagccacaccaagctaatataaaaaatactttgcaagaatgtaagcttcatgaaggtaggatttttgagaacactgctgagacacagtaagcacttaaaataatggtacatcttaccatcagtagcatcttaagttctatgaaatgtggcagttttataacagggaactaacaaatataaatctaacaaatatgacagttaacatcaatggcttgcttgcattattcagtctgttttccttgtttcctgttagctcagatacccacacagttttgttctaaatacacgttcagttaaacattatattctaatagtgttttcctttttatgagacaggcctttcttagttgtccaggctggagtgtggtggcacaatcttggctcactgcaacctccacttcgtgggctcaagcgatactcccacttcagcctcctaagtagctgggactacaggcacatgctatcatgctcaactaatttttgtaatttttgtaaagacaaggtctcactatgttgcccaggctggtctcgaactcctgagctcaaatgatcctcctgccttggcctcccaaagtgctgggatcacaagagtgagccaccacgcgcagccacatcaggttcttaaattaaaccactatatcaggtcattaaaccatttactttgcaatagttaagaagagggttatgggggttacgaggtgggaggggatgtgagaaaagcgatattgatagttttcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaagacaggtggtaaacgattcttcactccaactagaaaggaaaaaatgacaacatactatgaaaaaagctatgaggcaggaaaaagcacacgtcaaggcatggagatacggatatagactaggtaattttgcaaccacataagtgaaagaaaatttgctatccaatcttcctattctctactcccaagagcctagtgcttttgtatagttttcagctcagtaaagtgcctccagatttataaaagctcaatgacaataacaaggtatctttattacaaaatagttgttaaaagtttgattcgaaaaattttaaggaaacctttcaggtaactgaaagtggagggtaggggcgcgactcatgaaggagttttttaaccaaagaaatgatatgatacatttttaaatgaccacttcagttgcaatataaaataacagattttggaggaaaatgtcaatacaaggatatcaattatcaattattaggttactatattggttcaaggagagatgatggtggctgtggagatgagtgaaatcaacagatccaagatatattttagagagtattgtagaagactaggaatgggagtgaccagacaggaatgaagacttctagacttactgcacactgtcatgaggaaggatggggatggaagggtacagtggaataagctgggttttagcagaaggaatcaagagccccattacaaacacattaaatggcctggcgtggtggctcacgcctgtactcccagcactttgggaggctgaggcaggcggatcacctgaggtcaggagtttgagaccagcctgaccaacattgagaaaccttgtctctactaaaaatacaaaactagctgagcgtggtggcaggtgcctgtaatcccagctactggggaggctgaggtgggagaatcgcttggaccctggaggtggaagttgcagtgagctgaggtcgcgccactgcactacagcctgggcaacaagaacaaaactccatctcaaaaaataaaaaataaataaaaataaacacattaaacgtttataatgtatttacaagactaacaatcagataaagtctgaacttcagaaaggagatagagctgacctgaaaatataaattacgaactattgttatatgaatgttacttaaaagacgaggaggccaggtgtggtggctcatgcctgtaatcccagcactttgggaggccgaggcaggtggatcacttgaggtcaggagttcaagaccagcctggccaacatggcgaaaccccacctctaccaaaaaaaaaatacaaaaattaatcgagcacggtggcatgcacctgtcagcccagctactcaggaggctgaggcaggagaatcacttcaatctggaaggcggaagctgcagtgagctaaggtggtgccactgcactccagcctgggcaacagagtgagactcggtctccaaaaaaaaaagggcagaagatggggcggaagaatagagataggaaagaggaggatgttgagaactaaaccctgaggtacttttagtattcaaagtgtaggggggtctggaaatcttgtagagaccagtaggggttggagtatgacatcttccaataatgaattctcgttgctgtccccttatgggtctgggtctacctgatagtctcttctggaagtcggtatcacttgtgcttaatttctactcttttgtgccctctatacagcctctactacaaatcttttttgaagaagcacagggagaaataacttggggaaaaaaaaaagcctatcttttagaaatagattctgaaatatttacagatgaaataatatgttgtacagaattggcttcaaaatagtccaagtaaggggtggtctagataaaaaaaaaaagaacagctctgagtagatgcctgttacagttgggcaatgcacacatgggaaggttcactgcactggtctctctgaatatttcacaataaaacataaaacatagtatggaaggttggcaaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcgtagcccgggcggattcagccccacaaaatgggcgcagtttgcaaacagccccccggcctgggcgccgagggccagcggcgggcgggggcgcgcgacggcggctccggcccgggcccgccgctctcctccccccgacgcccggagccgccctgactttccgggcgggggggcgaggcagagggggaggggaaggcggcggcggggagcggctgctttttcttctctttcgggccctttcccggccttgctccgcaccgacggggcccgagcacggctggagaccgcagcccggccgggagggcgggcgggcgggggcagagagtgaaaccgcccccccgccccgcacaaacaagcaccgccgtctgcagcccgaacccgcacccaggccgccacccccggccgcctctttccagccggggagcgcgcttcagccgccccccgcgccgccgcggcgagacgagtcggcttcgctacggtgctcggttctcccgccggctcggcgagcggtggcggcggtggcggcggcactgggaaaatggcggccgagctccttttccctccccccctttaatctgaagcggagggagaatggagcgagcgagcaagcgggcgagcgccggggacacggggaggagggacagcagcgcctccgccggctgcggctgcggcggcgaagggccgctccaccccggcgcgccgccagggggcgcccgccgcgccgcccccgcgggccgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggtgagtctaacctgaggcactgacgccgtcacatgccctccgtgctggggccggcggtgcggctcgccagttgaggggcagggcgggccggcgccgcggagcgagaggacgtgagcgaggaactgtttgcactgtgtagtaaagagggtaaggccgtcggcaccacactattccaaggctaaccctgcagaaagctccctgaccagtgaagcggcttccgccgcccgccctttgtccctagcagccagcctccgtatactgcagcacggctgggcactagccccagcaccgcgctccgcagccaccagagttgggcggggtggggagggtgcacgtagtcactgcgcaggccccagccagggcccgcgccgggccagcccgggaagggacagccgggagccagaggggaagtgatggccccgccggcgccgggcccgctgggaactgtagttttcgtgaagaaacacgcgtcttgttttgggtgtcatggcttggcagatccgccaaaacaggcaaatggcattacacaatgagtatttatgcttcctgccgccaccaaaaggaagttcactgccatgctaaaagtttaacaaagaactccataaagaaacacaagtctcacaacaaaaagccaacttcccacctcgttaccagagttggtttaaagtggtggcaccttatcatttctcatgaccagtttatcagtacagaactttatattgtccccaaaataggacctttaaaataatggaacctttcctagacttaaagaattcataaacataatgtaatacaaagtgtcacacaaagtgtaattctaccaccctttaaagttgccaaaagatgagtggagtatcttgagatttaaaagactaatctaggattcatcaaaactggcttaaatgactgaagaaaaaatcgttcaaatcattaaatcatcaaattcggcagataagaagggtatgtatgctctactaccaaaaaggaagacgcaaaatgcttcacacttttttgtggcttaccagaaccaatatccggcattatacgtcacttctgcttatcaaaaaacaccctcacagtcgttacagaacggttttagtcttcccacaaagttacactaactcacctgcccctgcaacatctgcacctaggtttctgcgaatttccatttgtactcctaaaatcacactctcaagcatagtcatagttctcaaataccaaaggcaggcagtttggagtcatagggtcaaattacacaaagaataaactaatatttgtatacacatccaaaagaggtctttagtcttggatttttaatttacaaccctggggaaaaactttgacttttttattgtacacacatacacacataaatagtaattccacaaaatacagtagaagggtattggaccaacagatggcgaactagagccccaatctgaggctcctgaaatctaaattagcagaatgaaaaataccaaataaggcaaagccctttgcagcgtatacttaaatattaaattcagacacaccataacaaaataatcttactgctgctccaaatttttaagactgaactgtcagatttaattaggcaaccaaataagcaagattatatgaaatatatttttctaatggattaggagaaaactggaaaatgctcatttttaaaaccatgtatttgggggaactataaattccagtttcccctttctctcattgcttagtgcaagagtcaagagttcacagggtttatggcacttaaatcagtcaacctgttgtatattcttatctaaaatcagacatctttcttattaggcatccacttgtacttttatttttttgacagggtcctgctcggttgcccaggctagagtgcagtggtgcaatcaaactcactgcagcctcccaggctcaggcgatcctacctcagcctcttgagtagctggcactacaggcatatgccaccatgcccagctgttatttttttcactcctttttgttttggtagatacagagtctccctatgttgcccaggctggtctcgaactcctggactcgagtgctggcattacaggcatgagccaccacacaaaaatcttatgaagagaaacaaattttcttaaatttccccccaaaaaatagtggatgtccaaaaggctgattgaaaacacctacatacaaaataaaacaaacaaacaaaaaaagatttaaagaaaaaggcctggtgcagcagctcactcctgtaatcccagcactttgggagggtgaggtgggaggatcacttgagctccggagttagagaccagcctgggcaacagagtgagaccctatctctacaaacaaaattttaaattagccaagtgtggtagcatgtgcttacagtcccagctactccagaagctgaggggattgcttgagcctgggaggtcaaggctgcagtgagtcatgatcatgccattgtagtccaacctgggcaacagagcgagaccatctcaaaatgaaaagtgataaaaaaataaaaacaccaacatatttcaaatcactcttggaatagtcatgttgactctccaatatccactctattctgattagttttaacccattctctttgccaatgattggttaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagcctgaagatgccaccaacatcaaagggaatagagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaatgattgagttctaatgttttttagtatttgtatcttactttatgattacagtattttatataactaatcttattatttcttcctcagaaaagacattccatggccaggcatggtggctcacacctataatcccagcactttgagaggccaatgtgagagtattgcttgagcccaggagtttgagaacagcccagggaaaacagcaaaacttcatctcttcaaaaaataaataataaaaaaatttagccgggggtggtggcatacacctgtagtccaagctactcagaggctcaggcaggaggatcacttgagcccaggaggtcaaggctgcagtgaaccatgatcacgccactgcaaaccagcctgggcaacagagcaacaccccgtctccaaaaaaagaaaaagaaaggaagggaggaaggaaagaaagaaaaaaggaaaaggtgttccctcttacacacagctctgtatccatccatctttgtctgtgttctctctacctagaaaaagaggaccatccctcattaccaccattccttgttaattcctctctccaatccacctacaactcatgttatcctcttatattccaccacaccactgttatcgtctactcacttcacttgacaataatgtaggctgggcgtggtggctcatgcctgtaatcccagcactctggaaggccaaggcaggcagatcacctgaggccaggaattcgagaccagcctggccaacatggtgaaaccccgcctctactaaaaatacaaaaagtagccaagcatggtggtgcacgcctgtagttccagctactcgggaggctgaggcatgagaatcacttgagcccggaaggcagaggttgcagtgagccaagatcacaccactgcactccagcctacgcgacagaaggagactgtgtctcaaaaaaagaaccaataatgtacagagttggcactacattacccttggttaaatgctgtctgtaattcctctgagtttgttttcatataccagtcttgccacctcaagccagcctgaaagcccttgcaggcaggaactgtggttgttctaatttaagatctgtaactcatctatagataataaacgtattccaaaaaggcactctctaccttccctgccacagaccttctaaacaagccagaaattcctaaacagaataatctcacaaattcagtacctcgtatgtccaaactaatctcaaaaggacaatgaataactttttttgcacttaagaaaaagcaattattatatattaactcaggacaagttctaaagcctaggccatttagtttcaaaagcacaggggcccatttttttggttacttacctaggacctagcccagggcctggcacaaaagagacacatcataagaactgactgaataaatgaaaaaggtagagtgtagtacttaagcacacaggacctaggtagcccgattctaatcctgcctccctcacttattctttgtgttactttgggcaaagtacgtattctgctctgtaaaatggagatagtaataccacctacctcttaagtttaactattattattagtgaatgaagctattttccacagttctaaactttaaaggttaaaatctgagtgaagcaaaaatcagcacctctttcctaattcaaacttcaaacacctatctacttaggacttggacctactttaattaaaaaaaaaaaaaaaaaaaaaaaaaaagcctggatgtggtgactcacacctgtaattctagcactttgggagaccgaagcaagtggatcacctgaggcctggagtctgagaccagcctgggcaacatggtgaaaccctgtctcaactaaaaatacaaaaattagcctggcattgtggcacatgcctatagtcctagctacttgggaggctgaggcaggagaatcgcttgaacccacaaggtggaggatgcagtgagccaagatcgcaccactgcactccaacctgagtgacagagcgggactctgtttcaaaaacaaaatccctgtctagactctagcaaacaatgttttcattcatgaacttagataacactatatataaaaatacttttagctccctaaaaacatattctgagaatgattatttacaatcataaatctaatgccacattaaatacttcaaatacatttaattcaacaaaaatctagtgagtacctattaagctcaagaatttattctagatatcacagaaatgaacacataaacctatgtaaaaacccatattaaaattataaaagaaacatctttaagctgaaactgaggcatgttctcacattaatatttaaccagctaaatattaaatagccagagtcaactaaaccaaagttaagaaatttaagtcaaaaaatttaggatgtagaaggaatatgttcagccgccacattttattagtgtgaaaatgaggccaacagaaagaagccagttaagagattgccaaagcgtcaaagctggaatcagggtctctcagtcttcaattctcacttttcccacttctaattcaccagtgctactcaattggtgaactggatgtgcaaacatgctaaaggcattaaacctaaaccatactacctatttcacagtgtcacaagtataaagatttagccaaatgcaagtagaagaaaatcctcatactgattacaatgactacaaagctcagaaatcaagattttttttcattaaatggaggccttagctgattcaaaatatcatacagtatttttatgtactgactgaatccagtagaaacaaactttcagtaagattaaacaaaagcatttcataaatggcaaagtattacaagaatgcatagcattccttcatttcaatccaacctaacaagatattttcctcctcatactactgatacaaactgcaggatttacataaagatattattttgccatctcaccacagaactgacccaataattcatacaaaagaaaaactaattattaggcagcctcctaatttaactgtgttagtaatgagaacaatactgttgtaggttaaacctaaatgtactagtaagtctagaaataatttactttaggataattcagaagacaacattaaagctcagctgaatacaattatatcactgaaagaaacaagtcaggttctctcaggccatcagctattgttaaaatctaacacccaagattgttggtcttctccacagtggtggatttaatagcagctaccagcactcatttctagtgcaagcagtttaagcaggattttatacgaacattttaataaagttcctcaatgagtttacacacacacacacacacacacacacaccctgattattttggtgaattttagttaattctaatgtttttaactttagaatattttaaaattctcaaataactagaatgtgtgaacgttcaatgaccaaacatagaaggagtattctaatatactgattttgcagattaagcaatctacgcaggacccaaactttttatcagataataaagctgagtgtcagaatttggccaaaatgtaccaagaaactacctgagttcttttccaaaggaaacataaaggtaaatatgcagaacttcaaggcagctgtgagcagccaagttgtggagggcctgacaaaagtgagtcagaagggaaaatgttcaaagagaaaaggaggcagcaggtgtacaaggcaaaacacaccttaaaaaatatctttacaggctgggtgcggtagctcatgcctgtaatcccagcactttgggaggccaaggtgggcagatcacgagatccggagatcgagaccatcctggccaacgtggtgaaactccgtctctactaaaaatacaaaaaattagctgggcatggtggggggcacccgtagtcccagctactcgggaggctgaggcagcagaatggcatgaacctgggaggcggagcttgcagcgagcggagatcacgccagtgcactccagcctgggcgacagagcgaaactctgtctcaaaatatatatatatatatatttttctttttacgtcagttgctgattctaagttatgatgcaacttgtaaaatcttgttctgatggcatggcaaacctagggactttggaagatggcagacctgtttcctccaatgaagcagcataccattcttggaaagggaattactttttttttttttgagacacagtctcactctgctgcccaggctgccaggctggagtgcatggcaaaatctgggctcaccgcaacctccacctcctgggttcaagcgattctcctacctcagctgcccaagtaggtgggactacaggcgcgtaccaccatgcccggctaatctttgtatttttagtagagacggagtttcgccatgttggtcaggctggtctcaaaatcctgacctcaggtgatccgcccatctcagcctcccaaagtactgggattacaggcgtgagccaccacgcccagcctagaacattatttttaacccactaattcttggattcttgaacttgtttctatgtacactcaggaacatacagctacaaacggggagtaaccaaagccactgaatatatgcaggagcaacttttttggagtatcaatttaatcaaggattatagtaaaatcagatatacttttgttaaaataaacacaaatatattacaggttgaccatccctaatctgaaaattcaaaaccctccaaaatctgaaactttttgagtgccaacatgacacctcaaatggaaaattccacacgtgacacctttgcttctgatggttctctgaaccatcagaaacactgtttatttcaagaacaaaattattttaaattttgtataaaactggtcggttgtggtagctcatgcctgtaatcctaacactttgggagaccaagatgggaggatcatttgagccctggagttcaaaaccagcctgggcaacatagtgagaccctatctctgaaaaaaaaaaaaaaattaagtccaggtacagtggctcaggcctgtaatcccaacactggaaagccatggcaggtgaatcacttgagctctggagttcaagaccggcctgggcaatgtagcaaaacctatctctaccaaaaacacaaaaaattagccaggcatggtggcatgcacctgtagtcccagctacacaggaagccaaggtgggagaatcacttgagcctggaaggtggaggctacagtgagcagagatggcgctactgcactccaacctgagtaacagaatcagaccccatctcaaacaaacaaaaaaattagctgggcttggcaccgtgcatctgtaccagttagtaccagctacctgggaggctgaggcaggagaatgacttgagcccaggagttctaggctgctgtgagctaggatcacattactgcactccagcctgggcaacagtatgagacatcatctcttaaagaaaaaggtaaaaaaaagaaattatcttcaggctatgtgcataatgtgtacatgaaacatagaatttcatgtttagatttggatcccatctccaagatagtacattatgtacatgcaaacatcccaaaatctgaaaaatctgaaatccaaaaaacttctggtcccaagcatttcggataagggatattcaatgtatacagagcaaaaggcagaattctcactgtttcaagatagaaaaggagtcctcagagagatatgtcctgcttgtaacaaacagctccaaacagccctagaccctgaaaagtactttaaggaaagataaagaggtactggtttagaccatttatagataaatatgcatggctaaaacccctgaatgtaatccttccaggcagaagataaaacctgaaatctaacgtataaattgtcatgggtacaatattataaaagagaccataagttaccgagaacatgactggaattcaggaaatgctaaaggtcctgtcttatctctgtaactcatttacaaagaaatcatgtatgattttctcaactgcaatcttttttgtttctgaattagactgacaaaaattatagaatataatattcaatattttccaccatattccaaattctcactatcacatttaaacacaattttatctaatgaaatgtgtcccaaatgaaccaactttaaccagcatcagaaaaaataaaataaaatagttaaatgaaactgtatcttctttggtataagaagtccttcaggccagacgtggtggctcacatctctaatactagcactttgggaggccgaggccagtggtttgctagaactcaggagttcgagaccagcctgggcaacatggtgaaaacccgtctctactaaaatacaaaaaattagccaggcgtggtggcatgcgcctgtagtcccagctactcgggaggctgaagcaggagaattgcttgaacccagcgggaggtagaggttgcagtgtcagtgagctgagatcgcgccactgcactccagcctgaacgacagagcagactccgtctcaaaaaaaaagaaagaaatccttcagcacagagggtaggaaaaaacaactactcacacttcccagaatacctaccgtggcaataccaaaatatgaccatgcttgttaatatttgggctacggcattaaatgtttataacataacacaaacacttgtaatccaaatgtgaatgattatcttcaattttcagtaaaataagaccctataaaagccctaccattaatacatattcattcataaacatactgagtaccagtggatgttaaacactgtagaatctctaaggaaagaatactcggtcactttataagctatgtggtagtcaagaaaaatcctttctactcattgatacgttaaatgatcaaaaaatccaaagctaaaaaatgatcagagaacaatgaaaaaattttagtggctttatgcttccaattccattttcttctggactcttttctgaagcttgcctaaatcatcccaggaatgctaaaattgggtgttatttatggcataaccaaaatgaaataacaaagtaagtaccccaaataaaactaggagaaaaaatccagggaaccaagcaggcagtaaggatctaaagttctatacttggaacctctaccctgaatgttaaataatagatgttttttaaatagttgactaccaagtgtggtggcatgtgcctgtaatcctagctacttgggaggctgaggtggagagactacttgagcctaggagttctagactagtctggacaaatagcaagaccctgtctcacgggtaggggagcaggggaaggcaaccaagctgggtgtgccatgtgcctctagtcccagctacttgggaggctgagacaggaggagtgcttgaaaccataggccactgtactccagcctaggcaacataggaagaccctatctctaaaacaaacataaacaaaaaggccgggtgtggtggctcacacctgtaatcccagcacttgaggaggctgagttgggaggatcacttgaggtcaggagttcgagaccagcctggccaacatgataaaatttttgtatctttagtctctactaaaaacaaaaattagctgagtgtggtggcaggggcctgtaatcctagctacttgggaggctgaggcataagaatcatttgaacctgggaagtggaggttgcagtgagcggagatcacaccactgcactccagcctgggtaacagagcaagactctatctcaaaaaaacaaacagttatatctttaattattatcttcattcagtaattaggcaattagaatttacaattgctaaatgaatgttcaaagttcaaccaaaattagtccaagatgaagccaagaacacatctcaactcattcaataaagccattattactctgatgccaaaaccagacatagatatcacaagacaactacagaccaatatatcttatgaatacagatgtaaaagtcctcaacaaagcaaaatgaatccagcaacatattaaaaggcttatacaccattgctaagtatgacttaatcccagggattcaaggttggcttaacttctgaaaatcaattaatgtaatacaccatattaataaaggatacaaaccacatgatcatttgaatagatgcagaaaaagcacttaacaaaatccaacatgctttcatgataaaaacactcaacaaagtagaaattgaagaaaacatcttcaatctaataaaaaatacctatgggggaaaaaaagaatacctacaaaaaccccatagctaaaatcatacttaatggagaaagcctgaatgctttctccctcaggtcaagaacaaaacaaggatatccactcttaccactctgtttaacactgcactgaaggttatggccagggcaaataggcaagaaaaagaaataaaaatcactcaggcttaaaaaaaagaaggaaaactacctttatttgcagatgatataatcttgtatatagaaaatcctaagaaaatcccacaaataaactattagagccaataaacacatccaacacagttacaggatacaagctcaatatacaagtagtaatcgtatttctatacacaagcaataagcaatctgaacatgaaaagtttttaaaaattccacttacaatagcatccccccgccaaaaaaaaaagacttagaaagccaagcacgatggctcacacctgtaatcccagcactttgggaggccgaggcaggcggatcacttgaggtcaggagttcaagactagcctagccaacgtggtgaaaccccgtctctactaaaatataaaaattagttgggtgtggtggcaggtgcctgtaatcccagctactcaggaggctgaggcagtggaatcacttgaacccaggaggcggaggttgcaatgagccgagatcacaccactgtactttagcctaggtgacagaatgagacactgtctcaaaaaaaaaaaaaaaaaagacttagaaataaatttaacaaaagcagtgacaatcttatactctgagatatataaaaattacaaaagaagttacagaaatcctaactaaatggaaaggccaggtgtgatggctcacacctgtaatcccagcactttggtagactgaagtgggtgggctgcttgagcgcagaagttcaggatcagactaggcaacatggcaagaactcatctctacaaaaatacaaaaatgagctagatgtggtggcatgcacctgtaatcctagctgcttggggggctgaggagggaagatcacttgagcctagtaggttacagctgcagtgagccatgattgcattactgtacttcactgcagcctggatgacagaacaagactgtgtcccccaaaaaaaaaaaaaaaaaaaaaaggaaagatatcccatgttcatggatgagaatggatcagaagatacaactctgttaaaatggcaatattccctaaattgatctacagaatcaatgtgatcccagcatacccaaaagaaatttgaataggaaaaacaaagttgggggactcacacttcctgatttgaaaacataattcaaagctatggaaatcaagacagtgtggtagtggcataaggataaacatacagatcaatggaatataagtgtgggttcagaaataaacctttacactgacagtcaattgattttatgacaaaaatgccaagacaattcagtggaggaaagaatggtctttttaagccaagtgctgtagctgacacctataatcccagcatttggggaggctgagacaggaggattgcttgaggccaggagtttgagactagccagggcaacaaagcaagacccccatctctacaagaaacaaacaatggtcttttcaacaaaccatgctgggacaactgaatattcacatgcagtagaatgaagctggaccactatatctcacaccatacacaaaaattaattctaattaaatttaaacacggattatagacctaaatgtaacagctaaaacaataaaattcctagaagaaaacaaagctaatcttcatttcatttggtggcctgacatcaaaaccacatgcaacaaaggaaaaaacaagtaaatttggcttcatcagaattataacattttgtacattaaaggacaccatcaagaaattgaaaacacaacccatagatgggagaaaatatttgcaaatcatgtatctcacaagggatttgtatctagtatatttaaagaactcttacaactcaacaataaaaagagaatccaattttaaaatgggcaaaggctgagcatggtggctcacaccagaaggagaggatcccttgaggcaaggattctgagacctgccagagcaatatagcaagaccctgtctctacaaaataaattaataataataaaaaaaaacaattagccaggcatggtggcacacacctgtagtcctagctactcaggagcttgaggcagaaggaacccttgagtccaggagtttgaagttccagaaactatgattgggccgggtgcggtggctcacgcctgtaatcctagcactttgggagtccaaggcgggtggatcatgaggtcaggagttcaagaccaacctggccaagatggtgaaaccccatctctactaaaaatacaaaaattagctgggcgtggtggtgggtgcctctaatcccagctacttgggaggctgaggcagagaatcacttgaacccaggaggcagagattgcagtgagccaagatagtgccactgaactccagcctgggtgacagagcaagactccatctccaaaaaaaaaaaaaaagaaaagaaaactgcgattggccactgcactctagccagagtgacagagcaagacctagcctaaaaaacaatagtgtataaaaataaaattaaaatgtgcagagaatttaaatagacatttctccaaagaagatatatgaatggccaataagcacatgaaaagatctcatcaggttgagcacaggggatcaggcctgtaatcccaacactttgggaggccaaggtgcggggactgcttgagctcaggagtttgagaccagcctgggcaacatggtaaaaccccatctctacaaaaaatacaaaaaggccaggtacagtggctcatgcctttaatcccagcactttgggaggctgaggcgggtggatcacctgatgtcaagagtttgagaccagcctggccaacatggtgaaaccccgtctctactaaaaagacaaaaattagccaggtgtgatggtaggcgcctgtaataccagctactggggaagctgaggcaggagaatcacttgaacctaggaggcggaggttacagtgagccaagatcacaccactgcactccaacctgggtgaaaggcaaaaatccgtctcaaaaaaaaaaaaagtttcaaagataaaacaaaaatcttgttaaagataaatacacgagatgctaaagaaataatctacttcttcaagtcatgctatcaatttgcaccaaaattttcatttcctatgtgtaggtgttgagggtcttgtacccatgataaatgacatacacctgttctgggctgacttttgttccccaaaagagatatatagtactccaaggggctgggcacagtggcacatgcctgtaatcccagcactttggaaggtcaaggccacagcatcgcttgagctcaggaattcaatatcagcctgggcaacatggcaagaccccggctctactaaaaatataaaaaaatagccaggtgtggcagtgcacacctgtagtcccagctacccgggaagctgagatgggaggattgcttgagcctggggtttagggggctggaggttgcagtgatccaagtgccactgcactctagcctggatgacagagggagaccctgtctcaaaaaaaaaaaaaaaaaaaaagatatgtagtactcctaacattcagcacctcagaacctgatcttagagacaggatcttcaggccaggtggcttcccttcctctccgcgtcagtctgtcccacctcagctcagcccaccggagacagagggtgcaggaacctggaggcggaggttgcaggaagccgagatcctgcaactgcactccagcctgggcgacacagcaagactccgtctcaaaaaaaaaaaaaaaaccttacaacaaaatgatgcagcccgggcgcagtggctcacgcctgtaatcccagcactttgggaggccgagtggggcggatcatttgaggtcaggagttcgagaccagcctggccaacatggtgaaatcctatctcaactaaaaaaaaaccaaaaactacagaaattagccaggcgtgatggcgcatgcctgcagtctcagctgcttgggaggctgaggcaggagaattgcttgaacccgggagtcggaggttgcagtgagccaagattgcgccgattgcactccagcctgagtgacaagagcaaaactccatctcaaaaaaaaaagaaaatgcaaagtcacctaagagacagtttaaatacataaaaagctcgatgccaaataaaactggatgggtcacttgataagtgggattgataaaaagcaagacagctgatattatataattcttatttgcttcgatatttactggggaaggtagaggggaaaagctatctaaattactcttaataagcatacaaatctctaatagtgaatcaaatgcatcattaaatatactaaattcctcaaactgatatgtcagatgtcaggtagtcatgaagacccaaaatagtctccatgggttttttgttgttgtttttttgagacagagtctcactctgttgcccaggctggagtgcagtggcaccatctcgactcactgcaacctctgtctcccgggttcaagccattctcccacctcagcctcccaagtagctgggattacaggcatgtgccaccacatttggctgatttttgtatttttagtagagacagggtttcactatgttacccaggctgttctcaaactcctgacctcaagtgattcacccaactcggcctcccaaagtgctgggatttcaggtgtgagccaccacgaccagccccttctctgtgttttaaaggcatttaagtataaattattaaactgcaggacagaacatattagctgacggtcatatgagtgaccttctctaaatgccaggaggatagaatccacttttcctttatcaatattttccttgctcaacttctgacatattaggtactcaataagtatgtgctgaaccaaaacgaacaaaaaaatgctgtcatcaaagtaacttccatctactcaagtaggctgcaacttcaaactgcccaaactagcaaatctctaataaagatgggctcagaagacatatcagcatgaataaccttctgaggaaaagacaacatggattctaaaagtggacatcacaccacaccagttcacccaaattctctgagaaaataaatatgtgtggctgggtgacggtggctcatgcctgtaatcccagcactttgggaggctgaggcgggtggatcatgaggtcaggagatcgagaccatcctagccaacatggtgaaaccccaactctactaaaaatacaaaaattagctgggtgtggtggtgagcacctgtagtcatagctactcgggaggctgaggcaggagaaacgcttgaacccgggaggcggaggttgtagtgagccgagatcgcaccactgcactccagcctgggcaacagagtgagactctgtctcaaaaaaaaaaaaaaaaaaaaaaaaaaaaaagacctgagtggccacaggatgagaacatttactgtagactggacataactgagacacagaaaattataggtagatgctgaggtacttccccaaatgaagaagtaaaaacagaagattgaaaatttttttagaaatgctatatttaacattttaatatattgtacaaaaaatatacagagaattccccattttgcagatgggatgatgagattcctaataatgaaataccacacgagttggaaaaataagggaacggagtgatggaaagggtttctaaatatattaaatgagaaacatttgcaaaaactaagatttatattcagcttagagaatgctttggcaagtataaaagctgtctaaatatgtgaagggttatctagcagaagacaaaccagacttgctctaagcagttcccgtgtagacaaaattgggcccaaagtggcaattccagaagggcacgcttcaactcaagctttctaaccatcagacctaactaaaaaggtggttcttaccttggattacctctaagagcccactgagatatgagtgttaaaaaattacatgcgaggaaatggcaggtatgttacagcatggacaaatgaaaagtaaggcatttacaggaaaaaaaatctaagctatacttaaaagactcatgccttcaagtcaaaaaaggaatttttgaataattatagaatattccctaaagacaatgtgatgttctatgcaaaaaaaaaaaaaaaaaaagggagggagggaggaccaaatcctattaggaaaaaactgtaaatcaagggtacccaatcgtttggcttccctgagccacactggaagaagagctgtcttgggccacacataaaatacactaaagtaacaatagctgatgagctaaaaaagaaaatcttaaaaaaaatctcataatgttttaagaaagtttacagatttgtgttgggccacattcaaagctgtcctgggccgcatgcagcctgtgggccatgggtcggacaagcttgctgtaaatagaacatattttcttatccttctaccaaatcacagtgtagttataactaaaatgcagttctgagtagttatcataaatccagaaagggaaagcaatgctgacaaagatcctggaaggaggtttcactggagattaaattaaaaagtcaagcatcttcagttgagaaacatgaaagcaaaggggcaatgtgatcaaaatcagaaaacgtatcaatatggtaaatactaatttattcaccttttatgcttgaaaagtatttctttatataacagataaaagaaacttgtggattgtgttaccacaatctacaagttaaaaatagattcaagtgctcggataaatgtaggtatattaggtccattcaggtcctacaggatagaagtgctatcagacgtgaggccctaaatttctgaggttaacatcttaacagataacaatgtttcacctgaaaacatcacttggtgccaatttagacagaacaattggttggacagaccccggacagacagactcaaggaggctggttggtatagacttccttccattcttttacctcagtatgtatgtgtgtgtaatatatacatacatattatactagaacatatatacattccttatctttatacacttagaatgctccttatatagctctgcaccctgaatttttcatttatcatttactcaacatcctaagacattaaaaattctttttttttttttagacagagacttgctctgtcaacaggctggagtgcagtggcaccatctcagctcactgcaacctccaactccctggtccaagcaattctcctgcctcagcctcctgagtagctgggatttcaggcacgtgccaccacgcccagctaatttttgtatttttagtagagatggggtttcaccatgttggccaggatggtctcgatctcctgacctcataatccgcccacctcggcctcctgaagtgctggaattacgggcatgagccaccgcacccggccagaaaaattctttcaaatactattccatggttgtaaatgtccatccttaaatataccatgatttattttcctataaatcttgctgctcatttaggtttattctcaattctcactaatatgaataatgttacaatgaacatctttgttcacaaatctttctatgtatcttaatttttcccctttaggataaattcctagatgtgcaattactgaattaaagaacgtttttaattttgccaatatatgttgccaaaatatctttcaaaaaaactaggcccaatgcacactccactagcagtttcagagattgtcccctcaccaccttcgacagcacagtcaactgtaaatctgataggttaaaaaaagagtatgtcatttaatctgcattcctttgattacttatcaggataaaaatgtttctcatatgcttcttggtcatttgtatttcttccttatgaactctgatcatgttctttgccagcaaaacttttctttctcttggccgacaaactttctgtggaaaaccagctgagatggaatcatttaaatatcagcaactgcagctccccctgctgacagataaattaccaccaccatcaagtgcccagtaaaaaaaagtgagctagaaccatacgcttgcctgtcttctgggctgctgctacaaatacaaattatacacggtaataaaaaagaaaatactgtgtatctaaactcatacttaacagagctgtgatggagaaggcaagggggacaagcgttttatttgttttttgttgttgttgttgttgttgttgttttttgagacggagtctcgctctgtggcccaggctggagagtagtggcgtgatctcagctcactgcaagctccgcctgctgggttcacaccattctcctgccacagcctcccgagtagctgggactacaggcacccaacaccacgcccggctaattttttttttttttttttttttagtagagacggggtttcaccatgttagccaggatggtcttgatctcctgacctcatgatgggcccgcctcggcctcccaaagtgctgggattacaggcgtgagccaccgtgcccggcccaaacgttttctaatgtgcaggaactaggcggggtgcagtggctcacacctgtaatcccagtactttgtggaggccgaggtgggtggatcacctgaggtcaggagttcaagaccagcctggccaacatggtgaaaccctgtctctactaaaaatataacaatcagccgggtgtggtggcacgtgcctgtagtccgagatactcaggaggctgaggaacgaggattgcttgaacccaggaggtggaggttgcagtgagccgagactgcgccactgcactccagcctgggcaacagagtgagactccatttaaaaaaaaaaaaactaatatgcaagaactaatgtcacaaacaattctaaaaatcaattccctgccaaatatactacctggcacatataaacatcacagacctaaatattcatttccctatactttaactatgtgaaaacactctaaattaccaaatgacactgggtggtcagcaaactagttctctttttccaaaagcaaaaacaacaaaaacacttttgccctttagcattcaaagaaagagtattaaaaatcttaattcttggcaatccttattccaaagttgcttgcacttatcagactgggaccaatagatccaaagagtaaggccaagactggcaaatgcatgtgactctcagcttttccactgataccctcctaaagatgcatgtcccaagtccagcaatacagtctttaacactcatttactaagtgccatcaagagcaagcagtgatggccgggtatggtggctcacgcctgtaatgccagcactttgggaggctgaggggggtggatcacctgaggtcaggagttcgcaaccagcctgaccaacatggtgacaccctgtctctactaaaaatacaaaaattagctgggcgtggtggcaggcacctgtaatcccagctatttgggaggctgaggcaggagaatcacttcaacctgggaggcagaggttgcagtgagccgagatcgcgccgttgcgctccagcctgggcaacaaagagcgaaattccgtctcaaaaaaaaaagaaacaaaaacagcaagcagtgaggataaaagacaagagcaagtcctcactctcaaagaacctagacactagctgggttcaaagtggagcaaactagcaatcagtacaatagaagtgctaggtctgcatatgcacactcacatgcacacacactaacagtttcagagattgtccccttaccacctttgacagcacagtcaactgcaaatctgataggtaaaaaatagtatgtcatttaatctgcattcctttgattatttatcagaataaaaatgtttctcatatgcttcttggtcatttgtatttctttatgaactctgatcataaagtgataatacctgggtccagaggaagcactcagtgtcagctactgttattactattatcactactgttattttgttttaaggctaatcaagtgaagcagtgggagtggagaaggaacaaagaaatctgtaactggctgtgatcaattaatagtaaacaccaatatacttggaccagccactactgttattaaagactagggggagtaagtttccagaacagggtagagtccatcttaagcagaggtaactgcttgtgtgaagacccagaggcaaagaacaacagggttcacagaaggaactgggcacaagctatctgtactactgcgtacaggatgctcaggaagaagtggagagatgatctggcaaaacatttcaactctaccttcaaagctagttgagccatggtggaagagggagggatatgatcatacgcttgaacatgcattttacaaggatcatgttggcagcgacttggaagagagaaagcagtcaaggagaatgattacaagacaacagaaggtcacgcagccaaaagggcgatgaaggtctggactcaaaaaggagaagtaggatgactaggaaaatattatgagctaggatctcaagaatgtggtgactagaatggcacaagaaggaacccagaggcctctcaaatccctgatttgagtgactggctgggtgacactaccgctcactaagatacgaagataggaagaggttggactggggaagtggataagatcattttaaaatgcccataagatggccagatgcagtggctcacgcctgtaatcccagcactttgggaggctgaggcaggtggatcacctgaggtcaggagttcaagcccagcctggccaacatggtgaaaccccatctctactaaaaatacaaaaactggccggacgtggtggcgcacacctgtaatcccagctacccggaggctgaggcaagagagtcgctggaacctgggaggcagaggctgccgtgagccgagaccgtgccactgcactccagcctgggggatagagcgagactccgtctcaatagtaataataataataaaaaaataaaataaaatgcccataggacatccaagtagagatgtccaggaagcaactgtgtatatgggattggagatcagaaaactagtcagagctggaaaaacacacatttgcaaatcatcggcatatagacggcaagtgaggcacaagtttatctaaggcattcctcataaactgcacagggtgagaggaagaagggtcaagggaaggcaaatactaatgtttttaggagcaaaagaggaaaaaagtctgcaaagaaaaccaagagtatgggccagacttggtgactcacacactttgggaggccgaggcaggtggatcacctgagatcaggagttcgagaccagcctggccaacatggtgaaacccatctctactaaaactacaaaaattagccagatgtggtggcgggcacctgtaatcccagctactggggaaactgaggcaggagaattgcttgaacccaggagacggaggttgcagtgagccgagatcacgccactgcactccagcctgggcaaaagagcaagactccgtctcaaaaaaaaaaaaaaaaaagtttcaaagataaaacaaaaatcttgttaaagataaatacatgagaagctaaataaataatctacttctttaagtcatgctatcaatttgcaccaaaattttcatttcctatgtgtaggtgtcgagggtctagtacccatgataaatgatatacacctgttctgggctgaattgtgttccccaaaagagatatgtagtactccaggggcctgggcacagtggcgcattcctgtaatcctagcactttgggaggccaaggccacaggatcgcttgagctcaggagttcaatatcagcctgggcaacatggcaagaccccatctctactaaaaatatttaaaaatagccagatgtggtagtgtgcacctgtagtcccagctactcaggaagctgaggtgggaggattacttgagtccaggggttagggggctggaggttgcagtgatccaagtgccactgcactccagcctgaatgacaaagggagaccctgtctcaaaaaaaaaaaaaaaaaaaaagagatatgtagtactcctaacattcagtacctcagaatgtgatcttagagacgggatcttcagaccaggtgcagtggctcacgcctgcaatctcagcactttaagaggccgaggtgggtggaccacttgaggtcaggagttcgagaccagcctggccaatgtggtgaaaccccatctctaccaaaaatgtaaaaattagctaggcacggtggcgagcacctgtaactccagctacttggaaggctaaggcagaagaatcacttgaacctaggaggaggaggttgcagtaagctgagatcaccccactgtactccagcctgggcaacaaagagagactctaaaaaaaaaaaaagagataggatcttcaaagaggtcataaagttaaaatgaggtcatcagagaggactctaatcccaatatgacttgtccttataaaaaaggggaaattgtggacacaaagaaatacacacagggaggctgggcgccgtggctcacgcctgtaatcccagcactttgggaggctgaggtgggcagatcacttaaggtcaggagtttgagaccagcctgggcaacaaggtgcagccctgtctctacaaaaaatacaaaatttaggctgggtgctgtggctcatgcctgtaatcccagcactttgggaggccaaggcaggcagatcacctgaggtcaggagttcaagaccggcctgggcaacatggtgaaaccctgtttctacaaaaaatacaaaaaattacctgggcatggtgacacgtgactgtaatcccagctacttaggaggctaaggaaggagaatcacctgaacctgagaggcagaggttgcagtgaaccgatattatgccactgcactccagcctgggcaacagagcaagactctgtctaaaaaaacaaaagaaatacacacagggagaactctacataaggactggagttatgctgccaccagaagctagaagagaggcttgaaacagatcctgtcccagttgcttcagagaaagcatgcctctgcccttagatttctagcctccagaacagggagacaataaatttctgttatttaagccactcagcatatgtcactctgtggcagcagccttagcaaacagatgtcataagaaaattcgcagctcaggtttactaagtacctaccaggtgctgttctaaacactctgcgtgaataaactcatttaatccttataaagtccactctaggatctaggtactatcattataccctttttacagtgtggacaccaaggttctaagaggttaatgagcttacccagtatcacatagccagagccctctctctcaccactagtgtatgaggagctattattaacagtaattacaataagagctggcgtggtggctcacgcctgtaatcccagcactttgggaggccaaggcgggtggatcacttgaggccaggagtttgagaccagcctggccaacatagtgaaaccccgtctctactaaaaatagaaaaataagccgggcatgctggcatgcgcctgtaatcccagctacttgagaggctgaggcaggagaattgcttgaactcaggagacacaggttgcagtgagccgagatcgtgccactgaactccagcctgggcgacacagcaagactccatctcaaaaaaaaaaaaaattagtaattacaataagaacagtagtagtccactgaaccaaacactgccctatgtcctttacagatataatacaaaagtcctctgaagtaagtgttattatttccagtatgaaggaggaacctgaatctcagagagattaagaaaatcgcccaaagtcacacggttaagagtgctgagattaggccgggcacggtggctcatgcctgtaatcccagcactttgggaggccgaggcgggtggatcacctgaggtcaggagtttaagaccagcctggccaagctggtgaaaccccatctctactaaaaataaaaaaaaaattagctggccatggtgacaggtgcctgtaatcccagctacttgggaggctgaggcaggagaatcacttgaacccaggaagtggaggttgcagtgagccaagatcacctggacaacaaagcgagactcttgtctcataaaaaaaaaaaaaggaagaagaatgctgagattatatctaattgctaacttaaggggatatacaatgaaaacctgtttttactaaaactttaagaacaagttaattttttttttttctttaatgagacaagagacaaggtctggctctatcacccaggctggactgcaggggcgcaatcacagttcactgcaacctccacctcccaggctcgagccatcctcccacctaggcctctcaagtagctgcaactacaggtgcacaccaccatgcctggctaattttcttttgtatttttagtagagatggggttttgccatgttgcccaggctgttctcaaactcgtgtgctccagcgatctgcctgttcagcctcctaaagtgctaggattacaggcgtgagccatcgcgtctggccaagttaaattttttaatgcctgactttgcagttcaatactagaaatatacatctataaattcaaaattcttgaagatcccaagagaacacatgtcctagattatgggcccttttgcgtgtgtatcccctcaaccactgttcaagaactattctctcggctgggcacggtggcccacgcctgtaatcccagcactttgggaggccgagttgggcggatcatgaggtcaggagatcgagaccatcctggctaacacggtgaaactccgtctctactaaaaatacaaaaaattagccgggcgtggtggcgggcgcctgtggtcccagctactcgggaggctgaggcaggagaatgacatgaacccaggaggcacagtttgcagtgagccgagattgcgccactgcactctagcctaggtgacagagtgaggctccgtctcaaaaaaacaaaaacaaaaacaaaaaaactattctctcagttagaacccttgccatttctctgacttccagacacagaaagagaagaaaaggaaggattgagatgctgttctttaaaatttttttttttttttgagacggagtctccctctgtcgcccagactggagtgcagtggcacgatctcggctcactgtaaactccgcctcccgggttcacgccattctcctgcctcagcctcccaagtagctgcaactacaggcgcctgccaccacgcccagctatttttttgtatttttagtagagacggggtttcaccgtgttagccaggatggtctcgatctcctgacctcatgatccgcccgcctcggcctcccaaagtgctgggattacaggcgtgagccactgcgcccagctaaaattttcaattttctatttaatttttaaaatctgatacaaacatcagaaagtgtaaaaagatataatgcaatgagaagtctccttcctactctgtcctctacctgaacaattcctagacctaacaggtaaccagtgccaccattttcttatttattcttctaaaggtttgtgttgttgctgttgtttgagacagagtctcgcttggtcagccaggctggaggacagcggcgtgatctcagctcactgcaagctccgtctcccgggctcaagcaattctcctgcctcagcctcccaagtagctgggattacaggtgtgtgccaccatgccccagctagtttttatattttcagtagagacggggtttcaccatattggccaggctggtctcagactcctgacctcaggtaatccacccaccttggactcccaaagtgctgggattacacgtgtgagccaccatgcccagccctaaagatcttttttttttttttttgcatacatacaccaatgcaaattatctttttctcctgtttttttttttccaaaaaacacaaagggtatcaaatcatacatactgttctgcatcttgctttcatcacttaactgtctgccttgcagatctttctatatcatattaaattatgttttaattctctcgttttgcttgtcaagaacagtttttacttcatttcaccatagttcagtctagcacacaaggcatccagcagccctaagaactacctgaaacaactgatgatggctccatgctacacactaaagaccctgtatcttttctctcctcctcatcttcatttcactcttttctccgactcactcaattctccttcctttccctattcctctcccatctcacccactccttagccctaaccctgacaactagaccctagtaacatcactgacattgcttagtcgtggctagaaatattcaggctttaaaaaggtacagacccctaacacagagaaaaagggataaataataatttccatgagaacttctaattaacgagagtgccttaaattgaggagttttggcttggagttattcttccttgttacttgcctcctctggcattttcatttgtgaagactgagtgagtgtgacgctattttctatacgcatggaaacaagcacatactcagtctaacatttacgcaatgcctgacagaacgacagagttcattctacaataagataattggaaacaaaatataagatctatataaaataaacatttgggctccaaaatatgcactttaattaacctatcatttctttttacttaaattaagtagctccaatctgaaactacatcttagaaatgttttaaggatattcaccaatgaaaaagagaataaagttccctctccccacttttattttccagcccacaaactcaatgctatcctccccgcaaaaaggacctttttttctgaccagacgaacactgtaatttttaaggtttctaagtaataaaaataggaagaaaacattaccccccaaaattggtttacacttagaagatgtttcccactgagcaaaggattggtaaggaacataatattaaggcaaccacctaactgcattcttaagtagtaacaggtggtaactcacgatatggagctgatttcctttctctattcctgccatgccagagacctctagtagaacttctgaggttactgtattacaacccaggttcagagagatttagaggtaaaaccttaaacactggaaatatctttaaaagtagggctttgtgtaccaaatacattcgttaaaacctaggaaactataaaatgaaatccaatgtattgatctcaatccccttgcctgcttcctaaagaggacagaggccaccaacactggtgctcaacacttgctaagtcgaaacactcttacacaggtcctctgattcttaacgggttcagaacttctggttgcattccccatgcaacccctccaactctacagggagaatgctggaaaaactgtgtcactttggcttcctgtatattaatataagcactcttatccagcaatagcagctgaaacataaatgaagatgagaactcagcctacatgacctaagatttcccacaagtccagatatttaggttacacacactgcactattgtctgatttctcctctgcatcaatctggaagtccacagagcagattagcacccaacaatcttaactaagctagtatcctactctgaagaaaggcgaagctggtggagggtttccaagactccttatccttctctgtccttcctcccatcccctccttacgtcttttctgtttgtttttatttaattttttttttaatgtatttttagtcacaagaaaatcaaagaagccacctacttaagtcttaagctctgccctttgcttagtcctaatggagagttctttggccatctatgtacaagagattagaggagccaaagagactggagaaccacatcaatgggagctttttcatctaaaggtcatctgtccacactgtccaaatgaggtttaccctgtgaaataaaacttggtgtaagtgctacctgctgagaaaaatagtatgaaatgtcacacaaaggactggggtgcagcaggaggactctgaaagagtcatacgtgtaaaccagcaggtcttagaatgccctaatatactatatgaagtttcagagtaaacaaatggttaatgacacatcttttgtaacacatgaatcagctactgatttgcaagagtgggacacaccctagtacctatgactctaaagtacctgtttgaaaagtggacctagatgtttgaattgccaacccatcctaagaccggaacataattttacaactatgtaagttgccataatttaaagttaaaaagatcactgcctttcattataatggaagttaatttgagaacttcattaaaacattcacaccgataatcaaagaacagtagagatacaaagtaaaatatagccaatcaatcctaggaagcaaacacaagaggcaagagaaatggcaggtaaaggaagtgaagaatagcaaattcaaaaactacaatattcccaattctaaagaaaaatgaataaaatgaggctggtaatgaaaaaataacacatcttaccttaagaggcatccaagtagcattcatagtgtcaggatataaagacaatactcagaaatgagcaagaagtcttagtaattccctcggttaccaagtataagcaggtaggaaaatcttttgtttcgagaaggtatctgaaagagaggattttcatttagactaaaaaataatcaagacaatgcaaatagtttaagctacctgggcagggattttgaagtactatttgcctcatcgcactaaaaaagtatagaaaatacagtcccctttagaaaagggcaaatgtgtgtctccatatatatgtgtgtagaaacatactttacataaaaagagaaataaatatgtaacacgtattttagataatgtaaaattgcttatcaaacaattagccaaaatcccagagagaataaagtaattttccagggtacttcataaacactaaacgtgatttgttaactaaccgtctaaagaaagacccttgccacatttaattatatttagtaaagtaaaacttctctaatcatcccgactgtcccaagattatgcttaagtttcagagtcaattccacatgaaaagtaaaacctattcttgactgaagtactagaaacaaataaaagacccttcttccccagagatcgttaaaagcagaccgagcaacttaattttgagggtgggaggaaggtaaatttgcctggaggcaggaggatggactaaatgacctctggtaggatcctcgttcaagtcctgggcctgtatacaattccagcttaaccagttactgcttcgcttaaaatggaggcttgcctgcgtagggacaaaaataacagcacccacttcttaaaaataaatgtcgaaaagtacccctttttaaataaaaataaaaaataaacacctctggagtggatgtgttcttgctatgcgtttgtcactgaggcttcgaagacttggcatcactttccttaccgctcaccggattttgggggaggagcggggggcgacagtttgactcttgacccaagtctcaggcggacttcagagccccacaggggcccccaactccagagccagagggagcggagaggcgagagcccgagatcgcacctccccccaccgcggaccccagtcccaaacccacccctcacctccccgcagtggggcgcctccttctgccccattcccattgttagggagggcagagcgcggggtgggctcagggcaggggcgcccgcggccgttgcccggctcgcttcaggaggggcgccccgcgggatgcggcttcccttcctctccgcgtcggtccgtcccacctcggctcggcctggcgccccgaggtccgctccgcgcccccggccgcggccccggcccgccccccgggcagccaggccctcaggccagtcggccggcagccggcgtcccaggcctacgagtgggcgctgggcgggggtccccgtgccccacacacgcgtcccctctcccccagccccgccgcttccagggccctcggcggcgcccgctccccgggccccgcggccccccgcctcccagccgggccgctccctcgagctcgtcgggtcagggacacctcctctacctcaccatcaccctggcccactcgtgcccccacccccaggggcaccagtgccaaaggcagctcccccagccccggacctacctgcacggttcaaccaagcctagaagtgggggcggggaatcttccgccctcctctggcgcccattggcccttcaggggcacatcgtgagcgccattggctgagcaatggtgtccgtcagagcgatggggcgggacagaagggggagagggatgctggtgccttggcgtctctgtctctgtgtatctcgttgtctctgtctctgtctcggcccttggaaacgagaggcttttggctgagaggactagaagggggcctgaggtgggaggaataggaataggaatcctgacagagcgtcacgccagttggccactctgaacgccctacctaagtcccctttaggttctcttctccatcacccccaacccctgcccctcacccctcgaggttctttcatccaggaagcgacgtgatgaaaactccaggccggaaggccatagggagagatgttatatatgtatataaaatatacacataaaaatgtttatatataaactcaaccagatatcagttcactagggcctggaaaggaaagggcacacatctcacagacagggaaggacttgagatagagccggtagaagaaggaatcaaaaatcactctaagagctggcaacagtggttacctcctgggagaggaactgagtgcctagggaaccagtgggcggaagacttacatatctcggcatatcatttgtatccattgatttttgcaccattcatcaagattccaatttaaagaaaaggatttaaatgtttaaataaggtcgcaaaaccaggggacagacaagataattgggcaggaaaattggcgcaacatgcagatttggggaggaatcttagcttttaatatgttcagctcccggtaacagggttttgtaaaacccagtgaaggtgtcccagaggcaactgaagttatggaacttgagagagggtagacaatcaggactagagaagatgcagggtcctctgcctaaagatagtgatctatgacatgctaaaggataaactcccaaagaagggtaataagacacccacagtaaaaggtaggaggacgaaaaagaaggtcagtgaggtaaaagaaacaatattaaagaggcatgaaaattaagggaggaagggtctgtggaaaatagaataataaaactatgagagaggccgggcacggtggctcacacctgtaatcccagcactttgggaggccaaggcgggtggatcacctgaggtcaggagttcgagaccagcctgcgcagcatggtgaaacccgatctctaatagaaatgcaaaaaaaaaattagccaagcgtggtggcgcgcctctgtaatcccagctactggaaaggctgaggtgggagaattgcttgaaccgggaggcggaggctgcagtgagccaagatcgcgccactgcactccagcctgggcgacacagtgagaccctgtttcaaaaaaaaaaaaaaaaaaaaaaaaacaacaaacaaactgtgagagcctcataggtcttacctctttacctctttaggctctggtaaccatgggacaataagaatgaaagccaaggccgggcacggtggctcacgcctgtaatcccagcattttgggaggccaaggtgggcggatcacaaggtcaggagatcaagaccatcctggccaacatggtgaaaccacgggcatggtggcgcatgcctgtaatcccagctactcgggaggctgaggcaggagaattgcttgaaccagggagtcagaggttccagtgagccgatatcacgccactgcactccagcctggatgacagagtgagactccgactcaaaaaaaaaaaaaaaaaaaaaaaaaacaacacctttatcgattaagaatcttttttctgagtttattaattctatttaaatcaaccccagaaaacaccttcaacacagcctctcatttcatatctgtaaaatggggcaaaaaaaaaaatagttcctaccctttagagttgttgtgaagattaaattagtgaatacatatgatggatttttttttcttttttcttttttatgagacacagtctcgctctgtctcccaggctggagtgcagtggcactatctcagctcactgcaagctccgccttccgggttcacgccattctcctgcctcagcctcctgagtagctgggactacaggcgtccgccagcatgcccgactaattttttgttatttttagtagatacggggtttcaccgtgttagccaggatggtctcaatctcctgacctcgtgatccgcccgacttggcctcccaagtgctgggattacaggcatgagccatggcgcccggcctgtgtgatggattttttaagagcctgactggcggggtgaggtggctcatgactgtaatcgcagcactttgagaggctgaggcaggtgaatcacttgaagccaggagttcgagaccagcctgggcaacatggcgagacctcgtctctacaaaaacacacacacaaaaattagctgggtatgatggtgcatgcctgtagtcccagctactcaggagactgaggtgagggtcgcttgagcctgggaggcagaggttgcagtcagccgagatctcaccactgcatttcagcctgggtgacagtgtaagaacctgtcaaaacaacaacaacaaaaaaaacaaaacaacaacaacaaaaaaacgcacgaaaaaaaccacataagctccttgagggcagaaactgtcccctagtcttctatattttatttcacacaatgtacagaagactaaatgaataattgttagctggtttttttttttaaaggggataagatcagttacaatgtctttttcctcagtcaatcacataagtatctaaaatgacattccaaagtaaggacaggagtttaaatcctgaactatggtatctaaagtaaacttgaactttccttatttttaaaaaattttggccgggcgcggtggctcacgcctgtaatcccagcactttgggaagctgaggcgggcagatcacaaggtcaagagatctagaccatccttgccaacatggtgaaaccccatctccactaaaaatacaaaaattagctgggcgtggtggcacggacctgtagtcctagctacttgggaggctgaggcaggagaaccgcttgaacccgggaggaggagactgcagtgagccgagatcacgccactgcactccagactggcgacagactgtctcaaaaaaaaaaaaaaaagaaaaagaaaaaagaaaagaaaaaaattccatacatagaattctgtgtggcattttagagaaaatcatggtgactagagacaccaggtgaaatttttttttttttttttttggtgacacaaccccaggagatcctgtgaacatgtgtcccttgaccaggtgaatttcaggagcttgcactagtcccaggttagctggcaccaggttggccctagtttgagtgccttccacataccaggtactgtgctggagaagtaacatcaaaaaggaaaatcaaatttcatcttcaataagcaatcacaatacactgtgatgagagttagggtgaaggaggttcaggttaccatgggcttatattaggagggcaaattctgtcttcaagtctttttgcttcaacagtagcgtttagatcttgtgggctgggcatggtggctctagcctgaaatcccagcactttgggagggtgaagtgggcagactgcttgagcccaggagttgcagattagcctggcaacatggcgaaaccccgtctctacaaaaaatacaaaagtcagccaggcatagtggtgcctgcctgtagtttcagctacttgggaggctgaggtaggaggatcgcttgaccccaggagttcaaggctgcagtgagctaccatcgagccacttcacttcagcctgggccgcagaataagaccctgtctgaaaaaaaaaatcttgtgatataataacagcttgtgcactcttcgatagctcagctggtagagcagagggctgtagactgcatagataataataacagtttgcgtttttgagtcaaagatgataccccagaatcattatcgaaaataatggttgatccattcacctgtgcctatgactgtgagccacattgtgaccaatctgtgagcaacatgggtgggaatgcagtttggggccatggaactcacttaacaggaagttccaatagcagtggatttaccatgttgcggctgtaggatcttggacaaatatttaatgacctctgtctctcagttctctcaataataaaacatccctccgagagttgctgtaaaggttaacatagggggagtcttgcaaatagtaggtgctaaaatcctgtcttgaaaaaaaaaaaaaaatatatatatatatatatatatatatatatatatgaagagatgagatcttcaattgtacagactgtccctgtacccattcatttgcatttcttttcctttacaataatacatatctatgatttcctttcattcccactgtcatcaatttagttagattactgggcagagatcaccagtggggctagagtaaaatgaaaataaatgtacattgactctaggtattcctaagtaatagcacagtttactgtgttctccctcataaatcctggtagctgaatgttgcctgcttttagcagttacgtttctgctcatctcaccctcaatgttcattaagaaaatagttattgaatggccaggctcactggctcacgcctgtaatctattacaggcgtgagccaccgtacccagccttggttatcatatttctaatttataatagtttttcttgttttcttattgttcattttttatagcatcctgttcttatattatggatatatatcttcaggtctcgctgaagaaataaagaggtgtatgtgtatatatgtgtgtgtgtattatctttatttttattttttgagatggaatcttactctgtcgcccaggctgtagtgcagtggcgcttttgggaggctgaggtggaaggatcacttaaggccaatatttggagaccagccagggcaacataacaagacccccatctctacaaaaaaattaaaaattagctggccatggtggtgagtgcctgtagtctcagctacttgggaggctgaggcaggaggattgcttgagcccaggaggttgaggggggaggtgagccatgattgagccactgcactccagcctaggtgacagagtgagaccccatctctaaaaaaaaagagagagagaaataaaatagttattgagcacctactgtatgtcaggtccaagaccctaaagatgtaaagatgaataaggtggtgaccctgccttccagtttccacaaaggtggggaatatggataaaagcagacaaagccattgccatgggataagggcagagaatagcatgtgcaaattatagaaggtgagggataatataccactttccagaaactgatggttcaatgaggctaaagcatggagttcaagaaaggaaaccagatgagattaactgcaatgtggttctcaaacttaaatgtgcataaaaactggccttgttgactgggcacagtgactcacaccggtaatccaagcactttgggaggtcgaggcgggcggatcgcttgaggtcaggagttcgaaactagcctggccaatgtggtgaaaccccatttctttttttttctttttcttttttttttttttttttttttgagacagagtctcgctgtcgtccaggctggagtgcagtggcgtgatctcggctcaccgcaagctccgcctcctgggttcacgccattctcctacctcagcctcccgagtagctgggactacaggcacccgctaccatgcccggctaatttttttgtatttttagtagagacggggtttcaccatgttagccaggatggtctcgatctcctgacctcgtgatccgtccgccttggcctcccaaagtgctgggattacaggcgtgagccaccgcgcccggcctgaaaccccatttctactaaaaatgcaaaaattagctgggtgtggtggtgcacacctatagtcccagctgctcaggaggttgaggcgggagaatcacttcaacctgggaggtggagatggagtaagccaagatcaagccactgcactccagcctgagtgacacagcgagactctgtctccaaaaaacaaacaaacgaacaaaaaactggccttgtttacatagtctcgcaagctccaagcctagagatcttgatggagcgggtcagagtgctgctgctcggagggctacactctgagaaccaccgatggagaagaagggcggggtcaacttgcagagctgtgctgggaggtgtgtgctgcagccttgagggggtgaagaacctttgagaggttttaagcctgcaagagatgtggtcacatttatattttagaaaaatcaccctgtgtgcaatatgaaaaatgaaacagagagggcaagactggagtcagggagagcagttaggaggctgctgcagaaacccaggcaagaaatcataaagacctgaaataaaacaatgccagtggggaacggggaagagaggccaaatccaaggggtatttaggagccagaattgagagggtgtgatgagtgttgatgggatacaggacaggatcctgagatggcttgcaggtcttcagctttgagtgacccatggaagcgaaggaagatgggaaggagggtgcctatcacacagagagaatgaaggtttgagaggcaagtgtagcttttgacattttgcttttgaaatgtctatgggacatcagaaataatctcaaaagaccacaagtcaggcagggcgcggtggctcacgcttgtaattccagcactttgggaggccgaggtgggcagatcacgaagtcaggagctcaagaccagcctggccaacatggtgaaaccccgtctctactaaaaattcaaaaattagctgggcatggtggcgggcacctgtaatcccagctacttgggaggctgaggcaggagaatcacttgaacctgggaggcggaggttgcaatgagctgggatcgagccatcgcactccagcctgggcaacaagagtaaaactctgcctaaaaaaaaaaaaaaaccatgagtcactggttaacagcctgagcggcagaaatctcacagttctgagtctgaatcctatctagcctggctctgaaactcacaatctggagctggggcttggtgcagtggctcaggcctgtaatcccagcactgtgggaggctgaggcaggtggattgcttgaggccaggagtttgagagcagcctggccaacatggtgaaaccccatctctactaaaaatacagttagccaggcatgatggtgtgcacctgtaatcccagctacttgggaggctgaggcacgacaatcgctggagcccaggaggcagacgttgcagtgagccgagattgtgctactgcactccagcctgggcaacacagcaacactgtctaaaaaaaaaaaaaaaaatgctgggcgcggtggtttacgtctgtaatcccacttttagaggctgaggtgggaggatcacctgaagccaggagctcaagaccagcctggccaacatggtaaaacccgccatcccctccctgccatgccccatctcccccaacactctcccaccctgtctctactaaaaatacaaaaattagccgggtgtggtggcacacacctataatctcagctacatgggaggctgaggcataagaattgcttgagcccggaaggtggaggttgcagtgagccaagatcgcaccactgcactccagcctgggtgacagagcaagactctctcttaaaaaaaaaaaaaaaaagaattttttttttaaatatagagatgggctttctgtgtttcccaggctatactcaagctcctgggctcaagctattctcctgcctctgccttcaaccagcctcaatcctccaattttcttattttttatatttttcaacaccttttaaattctacattctggccagctgcagtggctcatgcctataatccagcactttgagaggttgagatatgagacttgcttgaggccaggagtttgaggcttgcagtaagctagaatggcgccacggcacagcagcttgggagacagagcaagaccttgtctcaaaagaaaaagaatttaaatactacattctaggagatttcttcaaccttcaaattttgtattgaatttttaattttggcttttatttatttattttttttttgagacaggttctcactctgtcacccaggttggaatgcggtggcttgatctcagctcactgcaacctctgcctcctgggttcaagtgattctcctgcctcagcctcctgagtagctgggattgcaggcgtggtccagcatgcccagcttatttttgtattttcagtagagacggggtttcaccatattggccaggttggtctcaaactcctggcctcaagtgatccacatgcctcagcctcccaaggtgctgagattacaggtgtgagccactgcacccagccttggctatcatatttctaatttatgatagtttttcttgctttcttattgttcattttttatagcatcctgttcttatgttatggatatatatcttcaggtctcgctgaagaaataaagaggtgtatgtgtatatgtgtgtgtgtattatttttatttttattttttgagacggagtctcactctgttgcccaggctggagtgcagtggcacaatcccagctggctgcaacctctgcttcccaggttcaactgatcctcccacctcaatctcccaagtagctgggattacaggcacctgtcaccatgcccggctaatttttctttctttgtttcttttttttttttttttttttttttttgagatagagtctctgttgcccaggacggagtgcagtggtgtgatctcggctcactgcaagctccacctcctgggttcaagagattctcctgcctcagcctcccaagtagctgggattacaagcgtgtgccaccacacccagctaatttttgtatttttagtagagatggggtttcaccatgttgtccaggctgatctcaaactcctgacctcaaatgatccaccttcttcagcccgccaaagtgctgggattacatgcatgagccaccacaccagcaaaatttttgtatttttagtagagatagggtttcgccatatgtgtgtgtgttttaagtttttctgttttcatttctcttggcatatatacctcggaatggaattactgggtcatatgggagctctgtgttaaacacttgtgtcatatctaagaaaacttgctaatccaaaggtcataaagatgtatgtctatgttttcctctaaggccaacatggtgaaacactgtctctattaaaaaaataaaaactgggccgggcatggttgctcatgcctgtaatcccagcactttgggaggccaaggtgggtggatcacctgtggtcgggagttcgaggccagcctgatcaacatgcagaaaccccgtctctactaaaaatacaaaaaaattagcagggcatggtggcgcatgcctgtaatctcagctacttgggagctgaggcaggagaatcgcttgaacgcaggaggcagaggttgcggtgagccaagatcgtgccattgcactccagcctgggcaacaagagcaaaactcggtctcaaaaaaaaaaaaaaaaattagttgggcgtggtggcgcgcacctgtagtcccagctactccagaggctgaggcaggagaatggcttgaacccaggaggtggaggttgcagtgagctgagatcatgccactgcactccagcctggcaacagagcaacagagcaagactccatctaaaaacaaaaaaaagagttttctacttttcagtctaacaaatgttttataaacaaaggctttgttatattttgagttaatttttatagataatatgaggtgaggtttcaacttcattctattgtgtgtgggtatccagttgtcccaggaccattgtttgaaaagacttttttttctacactttctctcattgaattgtcttggcatatttgttaaaaatcagttgaccttggctgggcaccatggttcacacctgtaatcccagtattttgggaggccaaggcaagaagaccatttgagcccagaagttcaaaacccgcctgggcaatataggcacactccatttctaaaaataattattaaaaagattagctgggcaggccagacatggtggctcacgcctgtaatcccagcactttgggaggccaatgcaggtggatcacctgaggtcagaagttcaagaccagcctgaccaacatggagaaaccccatttctgctaaaaatacaaaattagtctggagtggtgactcatgcctgtaaatcccagctactagggaggctgaggcagaagaattgcttgaacccagaaggcggaggttgtggtgagccgagattgcgccattgcactccagcctgggcaacaagaatgaaactctgtctcaaaaaaaaaaagattagctgggcgtggtggcacatgcctgtggtcccagtgacttaggaggctgaggcagggggatcgggagacggaggctgcagtgagccttgatcactgcactccagcctgggtgacagagtgagaccctgtctcaaaaaagaaaaaaaatcagttgaccgtaatgtgagcactcatttctggactttcaattctattccattgatctatatgtcagtccttatgccagtgcccaggggctcaactactggtactgtgaattagattttgaatcaagaagcgtgagtcttccaattttgttcttatttttcaagattgttttgtctatttgaagttccttacaatttaatgtgaattttagaatcagcttgtccatttttgcaaaaaaggtagttgggattttgatagagattgtgttgagtctgtagatcaatttgggaggcattgctatgtgaagagtagtaagtgtttcaatccatgaacacacaatgtcttttcatgtatttaagtttaatttctttcaataatgttttgtagtttgcacttccttggttaaattcattcctaagttttttttggtgccattacaaatggaattgttttattaatttcatttttggattgttcatttctagtgtatagaaattcaactgagccaggtgtagtggtgcaccacctgtagtcccagctacttgggaggctgagtcaggaggattgcttgtggccatgtttgaggctatagtgcattataattgtgcctgtaaatgatcactgcattctagcctcggcaacatagtgcagtcttgtctcttaaaaaataaataaataaacaactgatttttgtacgttgatcttgtatcctccaactttgcaaaattaatttattactattaagactttgtggctgggcacggtggctcatgcctgtaatcccagcactttgggaggccaaggcgggcagatcacgaggtcaggagatcgagaccatcctggccaacacggtgaaaccccgtctctactaaaaatacaaaaaattagccaggcgcggtggcaggcacctgtagtcccagctacttgggaggctgaggcaggagaatggtgtgaacccgggtggcagagcttgcagtgagccaagatagcgccactgcagtccagcctgggcaaaagagtgagactccgtctcaaaaaaaaaaaaaaaaaaaagattttgctttattttgtgtttggtgtggatactttaggaaccaaaagataaataaataagaacaaggtctagcactttggtcaaatttattcctaagtgtgtgtttgtaaacgatattgtaaatgaattttcttagtttcattttcagcttgctaattgttactgtatagaaatacaatttatttatttatttactttttttttttttttttgagacagtctcgctctgttacccaggctggagtgcagtggtgtgatctcggctcactgcaacctctgcctcctgggttcaagcaattctcttgcctcagtctcccgaacagctgtgattacaggtgcgtgccgcaacccccagctaatttttgtatttttagtagagatgggttttcaccatgttggtcaggttagtctcaagatgttcttttttttttttttttttatcattttatttatttattttttaatttttatttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcctgcctttctattccacaaagccgccattgtcatcctggcccattctcaatgagctgttgggcacacctcccagacggggtggtggccgggcagaggggctcctcacttcccagtaggggcggccgggcagaggcgcccctcacctcccggacggggcggctggccgggcgggggggctgaccccccccccaccggtcaggttagtctcgaactcctgacctcatgatctgctcacctaggcctcccaaagtgctgggattataggcatgagccactgcgccaggccaattttttttatatcactcttacacctgcaactttgctgaatttgtttacttgttctgacggttttgtggattccttagaatttcctacatacaagatcatgtcatatgcaaatacatatggttttatttcttcctttctaatttgtgtggcttttatttctttttcttgctaatttcctggctagaaatttaagtataatgttgaatagaggtggcaagagtgaatatccttgtcttcttcctgatcttaggagaaaaacttatagtctttcatcattaagtattacctgtggggctggatgcgatggctcaagcctataatcacagcactttgggaggccaaggcgggtggatcatttgaggtcaggtgttcaagaccagcctggccaagatggtgaaacccccatctctactaaaaacatctctactaaaaatataaaaacttggcggggtgcagtggctcacacctgtaatctcaccactttaggaggccgaggcgggcagatcacgaggtcaggagatcaagaccatcccggctaacacagtgaaacccatctctactaaaaatacaaaaaaaaaaaaaagaaaattagctaggtgtcgtggcacacgcctgtagtcccagctacttgggaggctgaggcaggagaatcgcttgaacccgggagacagaggttgcagtgagccgagatcacaccactgcgctccagcctgggcgacagagcaagactccatctcaaaaaaaaaaataaacgtaaattagacaggcatggtggtgcgcacctgtagtcctagctactcaggaggctgaggaaggagaattgcttgaacctgggaggcagaggttgcagtgagtcgagagcatgccactgcactccagccagggtgacagagtaagactctgtctcaaaaaaaaaaaaaaggatttatgggaagtaattaaggtcaaatgaggtcataaagctgggcactgatctaatagaattagtgtctttatgagacgagaacccagagagctccctagctttctctctgccacatgaggccacttcaagaaggcaagccaggtaataaagcccacgctgaggtaggaggtggaactggactccagagatggggcttggacaccagaccaaattgatgactagctgaaacagggacagggtgaaagcagctttccataagacacgctcaaccagtgcaccatgtcagcttaccatttccatggcagaacccagagttaccaccccaccgccttttttttgagacggagtctcactctgtcgcccaggctggagtgcagtggcacagtcttggctcactgcaagctccacctcccgggttcaagcgattctcctgccttagcctcccgagtagctgggattacaggcgcctgccaccgcgccaaactgatttttgtatttttagtagagacagtgtttcaccatcttggccaggctggtcttgaacttttgacctcatgatccacctgccttggcctcccaaagtgctggaattacaggcctgagccactgtgctcagcctaccacccctttcaatggcaacaacttgacaacccagaagttatcagcctttttctagaaacgtctgtatagtctgccccttaatttgcatgtaattaaaggtcaatgtaaatatgactgcagaactgccctgagctgctactctggtcacactacctacagggtagccctgctctgcaaggagcagtccctctgctgttgctataggccactgcttcaataaaagttggcatctaggccaggtgcagtgggtaatgcctgtaatcccagcactctaggaggctgaggcgggtggatcatttgaggccaggagtttgagaccagcctggtcaacatggtgaaaccccatctctactaaaaatacaaaaaaattagttgggtgttttggcgcacacctgcactcccagctactcaggaggttgaggcgggagaatcacttgaacccaggaggcagagtctgcagtgagccactgcactccagcctgggtgacagagtgagaccctgtcccgaaaaaaaaaaaagttggcctctaacaccttcggtttgcccttgaattatttcctgggtgaagccaagaaccctctcagtctaagccccagttttgtggcttacctgccctgcatcaacaccagaaacttaaccctttgggaatctcgatcttggactttctagcctctagaaccatgagaaaatgatctgtattattaggctacccagtctatgatattctgttgtagcctggggtgactaagacattgagcctgtatgacttgaattttgttacctgcttggccccttgatggcatttcagtttgtgactcttggtttacgtgatcacgaagccaaaactgtttaggaaggaagcaaaatcaagacagattaaaaataaaaataaaaaataaaaggctgggcaccgtggctcacgccctcccagcacgttgggaggcaaaggtaggcagataacttgaggtcagcagttcaagaccagcctggccaacatgatgaaaccacatctctactaaaactacaaaaattagccaggcgtggtggtgggcacctgtaatcccaggtatttgagagggaggcaggagaatcacttgaacctgggaggtggaggttgcagtgagccgagatcacaccactgcactccagcctgggtgacagagcaagactctctctcaaaaaataaaataaaataaaataaaataaaataaaataaaataaaataaagagccgagcacgctggctcacacctgtaatcccacacttcgggagaaagaggtggcaggattgcttgagcccaggagtttgataccagcctaggtaacatggcaaaatcccatctcaattttaaaaaaattttaaaaaagaataatagggctgggcacgatggctcatgcctgtaatcccagcactttgggaggccaagatggatggatcacctgaggttgggagtttgcgaccagcctgaccaacatggagaaaccccatctccactaaaaatacaatattagcaggtcgtggtggcacatacctgtaatcccagctactcggaaggctgaggcaggagaatcgcttgaacctgggaggtggaggttgtggtgagccaagatcgtgccattgcactccagcttgggcaacaagagtgaaattccatctaaaaaaaaaaaaagaaagaaagaaataaggtattttacataaagattaaaaagaaattaaaaccattatttgaagataatggcttaaacagaaactctgcaaatccttagaataagaaagttcaggccaggtgtagtggcttgtgcctgtaatcccaatgcattgggaggctaaggtcggaggattgcttgagcccaggagtttgagacaagccgggtcaacataatgagatcgcatctctacaaaaaattgaaaaatgagccaggtgtggcagtgcgtgcctgtagtcctggctactcaggaggctgaggtgggaaggtcacttgagcctgaagagttcaaggctacagtgttatgatcatgccactgcactgcactccagcctgggagacagagcaagaccctgagaccctgtctcaaaaaacaaaataaaaaaccctcactatattgaacacaacatcaatgttcaatagccactctccttctccttttctaataaaattccacttttttgtgttccatcccaggaccacgatttatctaaactggtcattctggatcaataagtttggctaaaaataaataatatcgaaattggtcacaggaaatctattcttttttttttttttttttttttttttcagacaaagtctcactctgtcgcccaggctggagtgcagcagcatgatcttggctcactgcaacctctgcctcccgggttcaagcaattctctgcctcagcctcccaagtagctgggattacaggtgcctgccaccacgcctggctagtttttgtatttttagtagagatggggtttcaccatcttggccaggctggtcttgaactcctgaccttgcgttctacctgccttggcttcccaaagtgctgggtctgtcacccaggctggagtgcaatggtgcaatcatggctcactgcagcctcaacctccctgggctcagatgattctcccaccttagcctctcaagtagctgggattaaaggcatatgccaccatgcccagctaatttttctattttttttgtagagacagggcatccctaccttgcccaggctggtcttcaactcctggtttcaaaggatcctcctgcttcagcctcccaaagcactgggtctattattccctttcatattcaaacttaattctgcattttcaaggccttgaattttcaagggcagctttttctgtccctgaacttaatcttcagctcctctcacctcctgggaggttggggggtggggaagaaaagtcccaaccctctaatcctgctttggtcttttgccgccagcccccatcctgaagctaccagtcaatttgtttgcatacaagaagatatcactttggagattctaagtgtatacgaggaaatgaggtcaaagaccaaatatatatatttcactatatcacacttcaaacttttgtttactgtttcccttctcctactctattataaacctttgagggtggggactgtgagttatttatctttatattcccagtgtcaagagtgtttagctataatgggaatgaatctcaaagtttcttgaataaatgacaagaagaatcatagttgcatgaactaaattcattattctcagtccttgaggtaaatgaatatattgatattatgtctgcttactctttttttgcgagagagagaaagaggagggagggagggaaggaaggaaaaaaggaaggaaggcgaaaagagtgaaagaaaagagagagaaaaagagagagaaagaaggaaggggagggaaggaaggaaaagaaggagggaagaagggaaagggagggagaggaagaaaagaaagaagaaggaaggaaagaaagaaagaagaaaaggagggaggaaggaacgaagaaagggaaagaaggagggagggagggaaatgaaggaaagaaagaaaaaagaaagaaagaaaaaagaaaagaaaaggagggaggaaggaaggagggagggaaggatggaagaaagggaaagaaggagggaggaagggacatgaagagaataaagaaagaaagaagaaaagaaaagaaaaaagaaaagaaaagggagggctctgcgggcggcggcggcgcggggagccggttgcaggccgagatgctgcagatggacctgatcgacgcgacgggggacactcccggggccgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgcagttgtctcaggacacactgaataataattctctgggcaaaaagtacagttggcaggatcgggtgtctcgatcatcctcacccctgaagacaggggagcagacaccaccgcatgaacccatttgcctgagcgatgagctgcccccccagagcagccccgcccccaccacagatcgaggcacctccaccaacagcccacgctgctggagctggtgagcctgcggccgtgcttcagagactacagtgacgagagtgactcggccatcgtctacgacaactgtgcctccgtctcctcgccctatgagtcagccatcggagaggaatatgaggaggcctcccggccccagcctcctgcctgcctctccaaggactccacgcctgacgaacccgacgtccatttctccaagaagttcctgaacatcttcatgagtggccgctcccgctcctccagtgccgagtccttcgggctgttctcctgcatcatcaaccgggaggagcaggagcagacccaccggaccatattcaggtttgtgcctcgacacgaagacgaacctgagctggaagtggatgaccctctgctagtggagctccaggctgaagactactggtacgaggcctacaacatgcgcactggtgcccggggcatctttactgcctattacgccatcgaggtcaccaaggagcccgagcacatggcagccctggctaaaaacagtgactgggtggaccagttccgggtgaagttcctgggctcagtccaggttccctatcacaagggcgatgtcgtcctctctgccgctatgcaaaagattgccaccacccgccggctaaccgtgcactttaacccgccctccagctgtgtcctggagatcagcgtgcggggtgtgaagataggtatcaaggccgatgactcccaggaggccaaggggaataaatgtagccactttttccagttaaaaaacatctctttccgcggatatcatccaaagaacaacaagtactttgggttcatcaccaagcacctcgccgaccaccggtttgcctgccacgtctttgtgtctgaagactccaccaaagccctggcagagtccgtggggagagcattccagcagtttcacaagcagtttgtggagtacacctgccccacagaaaatatctacctggagtagccgcgcagccccgccctctgcgtcccccggccctcaggccagtgccaggacagctggctgctgacaggatgtggcactgcttgaggaggggcacctgccaccgccaggggatgaggaagtgggggccgctggctcagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccatacctcccctgccagggctcgggtgctctggctcctgccttgatgaagcccatgtcctgccttgatgaagcctgtgccacctgcaagtgcccgccctgcccctgtcccaacacccaccgaagagccctgagctcaggctgagcccagccacctcccaaggactttccagtgaggaaatggcaacacatggaagtgaagtccctgttctcagctctgtcatctgcagggcttctgggtggctcctgccactgacctcactggcatgctagcctgtggcaggcctaggacctcagcggggaggaggagctgctgcaaggccctatcccagcaggagagggaggcttcctgactgacacaggctagccccatcttggtcctgtcaccctggccccaactattaaagtgccatttcctgtcaaaaaaaaaaaaaaagaaaagaaaagaaaagggagggagggagggaggcaggaaggaaggaagagagggagggagggaagggaggaagaaagggaaagaaggagggagggagggaaatagaaagaaagaaggaaagaaaaagaaagaaagaaagagaaataaaataaaaattaaaaaaccataaggttaaagtaaaccctttttcttcatacagattaaaacacatgacttcaaattacagctttgcttcttaatagcttggtgatgtaggacgttatgtaacctctctgtgcctcagtttcctcatttataaaatagggcaataataatatctagcccataaggcattgtgaggattaaatgtgaaatgctgatcacaaatacctagcagcccaatagatactcactgtaataattattatttttataatttctgcaaaagtatggtgatgattcttgggttaacctaaaggcagattttcttttatttcttcctgtttcttttcttttccttgttcactttaaagaattaaaaagaaaattgattccagcattttggaataaaaatttgcatcaaaaagaatttattcattttattgacatacaaataaaatgtcatttgtttattcaataaacatttattaaatgtctggtaaatttcagacatcatgccaggcacagggatgacaatgacaataagatgtggtctctgccctcagggagctgatagtccaggagactgacaagtagacaggtgattacatgcaatgtaacaaaggctatgatgtcatacaagaagacaagtgggagtatgtgatgggagtatggttttgaccagttcctcctcttagatttatccctttttctttggctataaagcaaaagaattggtcctatttttttttcttaactttgcaaattaaaccataaattttaataactttataaagataaaaggcaagcggtcagattcagtggctcacacctataatcccaacactttgggaggccgaggcaggtggataacctgagatcaggagttcgagaccagcctggccaacatcgcgaaaccctgtctctactaaaaatacaaaaattagctaggtgtggtggcaggcacctgtaatcccagctactcaggaggctgaggcaggagaatcgcttgaacctgggaggcggagtttgcagtgagatgagatggagccattgctctccagcctgggctacagagcaagactctgtctcaaaacaaaacaaaacaaaacaaaacaaaaagatgagcaacttgaattatggaggacactagaaatagtgtttcctacagaatcagggcttcctaccaacatagtcacttctagggttttcgacctgaaaagttctgtggcatattgtttctttgctatccacttttttttccctatttttccccctctttctctcctctactttatctcctagagatctaggtagttcccaaaggaataatgctttacggagtctaatgttgatttattaggtaaaaacagaaaatgacttttttttttacccacaagttccataccaaaaaatgaatgtaaacttcttatgcagtttcacacattgaaaatgcaggttattttaattccattgcatttttcagaattctcaatcgcaatcctctgacaactgttgaagatccgtatctctttaaattactggcattaaaatatctgtaagtactatagtactcttgggagtcatgagatgatttatactctttttaaatttttcatcaaagattaagtattttgcatttaggctaaaatgtcataatttaaattttaactgagttattgaaaaacattattggcaaaggaaaggatgtgtaatggtcaagatagccagcaggggaaagagaacagtgttgaagaacccatatagatttggaacatgtagacacatggaggaatattacttaaccaagaaagcaaaggggaaaaggtgttcattattctaaaaaggaagaaaagagtaaataatcaagatgggtgaatgcaatatgaaaatgagaagtaagataatggtaaaaaaaaaaaacagtgtaagacctactcttgaatatcattaatttgatgatgcaaatcaactttaatttctttaataagagctctctggaattttgcggcaaataaactgttgaactggcttgttttatagggaagccaaaattgaagtaatcacatgtccttgaattatctttttaagtacagaattttttactggggttcatatcatgaatgtttcggctttcttcttcagagacgtgggaacaacgcaagtcccacttacaacacttaagaacattctcatgatgaccgttgaactggaaaaactgtaagttatttttttcttagacttattttcaccctgttgcgtttttaggtttgttttattattttcttaagtcaggtttattgagatataattttcatatactaacattcaccctttttaagtgtacaatttgatgagttttgacaaatgtatagttacataaccaccaccacattcccaatataaagcatttctgtcgcctcaaaaaggtccctcgtgtccctttgtagtcaatcacctcctcccaccgtcagcccctgttagctactaatctgatttcctatagttttgccttttccagaatatcttataaatgaaatcatatagcatgtagcctcttgtatttgacttctttcacttagcataattttttcttttttgagatggagtctcactgttgcccaggctgcagtgcagcggcatgacctagactcactgcaacctccacctcccaggttcaagtgattctcctgcctcagcctcctgagtagctgggattacaggcacatgccaccacgcctggctaatttttgtatttttagtagagacgaggtttcaccatgttggccaggctggtttggaagtcctgacctcaagtgatccgcccgccttggcttcccaaagtgctaggattacacgtgtgagccacctcacctggcctcacttatcatattattttttgaaattatgctgccatccatgttgctgcacccatcactacagctggccctccatatctgcaggttcctcatccatggattcaactgaacatggatggagaatacttgaaaaaaatgaaatatataaaataactataagacaataaaaacagtagaaaatttaaaatacagtataattatttacataccatttacactgtattaggtatttaaagtatacctgaggctatatacaaacattatgtcatttcatagaaaagacttcagcatctgtggactttggtgtcggcagggggtcctggagccaatcccctgcagacaccgagggacaactgttcactcctttttattgctcagtagtattccagttgtgtggaaaccccatctctactaaaaatacacaaattagccagatgtggtggcacacacctgtaatctcagctactcaggaggctgaggcacaagaagtgcttgaagctgggaggtggaggttgcagagtctcctttacacttgctgtcctccctccactgccgcctgacacactcctccccagcagtggcctcttcataggcaaatttaaggagcaccttttagtccttgtcctgcttgacttggccctgatgtttgaaattcttgataaatctttcttccggaaacacactctttctatgcttccaggaaatctttttcttggttctccagacaacttcttagactccttgaccaattccttcttgttgccaacaatggaaacaaaccagccctacctaagcaaagcacattaaaactcactagaaagatacaggggagggggcgcccactaaaccactaaagagacaggaggtggggagctgtaggaccaggtttgggaacctgcaagaatcaagaccagagcccctgaaatagcaagaagctggaagcacaggaactgtcagagccagatggctgtcactgcagtcagcgcctctgattgtttgtttttgagatggagtctcgctctgtcgcccaggctggagtgcagtggcatgatctcggctcactgcaacctccacctcccgggttcaagcaattctcctgcctcagcctcccgagtaactgggactacaggagcctgccaccatgcccgactagttctttatatttttaatagagatggggtttcaccatgttcgtctcaaactcctgaccccaggcgatccacttgcctcggcctcccaaagtgctgggattacaggcgtgagccaccatgcctggccagtttttgtatatttagtagagactggttttgccatgttggccaggttggtctcaaactcctgacctcaagtgatccatccacctccgcctcccaaagtgctgggattataggcatgaaccactgtgcccagccacctctgatagttttcatcgtcctcgggccactggctcccaaatcacggttccagacaaaagcttacaagtagtccagctttggccaggctcagtgtgatggttaatactgagtgccaacttgattggattgaaggatacaaaatattgatcttgggtgtgtccgtgagggtgttcccaaaggagattaacatttgagtcagcgggctgagaaaggcagacccacccttaatctgggtgggcacaagctaatcagctgccagcaaggctagaatataagcaggcagaaaaatgtgagagactggcttagcctcccagccaacatcttcctcccgtgctggatgcttcttaccctccaacatcggactccaagttcttcagttttggaactcagactggctctccttgctcctcagcctgcagacggcctattgtgggaccttgtgatcctgtgagttaatacttaataaactcctgtatatattccattaattctgtccctctagagaaccctgactaatacgctcagtgactcacacctgtaatcccagtactttgggaggctcaggcaggaggatggcttgagccccagagtcttcttcttctccttctccttgtccttctcttcccttcccctttctcctcttcctcttccttctcttcctcttcctcttcctctccttcctcttcctcttcttcctcttgtttgtttgagaaaggttctccctctgttgccaaggctggattgtagtggcacaattgtgactcactgcttctcagcctcctgagagcccaggagtttgaggctgcagtgagctatgatcacactaccacactcctgcctgggtgacagagcaagaccctgtctcaaaaaacaaacaaaaaactctggtatgatagaggtgaattgtctgttttatcctgataattctgcttaccttagtcccgtggttctcaactgggccaattttgctccccaagtgacatttggcaatatctgggcagaggtcaaggacgctgcttaacatctttttttttttttttttgagacacagttttgctcttgttgcccaggctggagtgaaatggcacgatctcgcctcactgcaacctctgtctcccgggttcaagcgattctcctgcctcagcctcccgagtagctgggattatgggcatgcaccatcacgcctggctaattttgtatttttagtagagatggggtttctccatgttggtcaggctggtctcaaactcccaaccttaggtgatcagcccacctcagcctcccaaagtgctgggattacaggtgtgagccacctcacctgtcctgcttaacgtcttaaaacacacaggacaattcccccataaaaaatgatgaccagccgaaaatgtcaacagtatcaaggtgaagaaattgccataaaggcttggtaaacagggatggtatgacgacactattgataggccacattaaaatacttagggccatatccattatccctgtttttatgatttcttctttgtccccatgcagtttcaggggcaaaataagggagtaagtcagaggtggttccaaatagacatctgggaatcttagggtgtaatatggccctcatggaggcccttgctgagcttagggcctgattctggaatcctagcattgccaagagaggcaggctggcaggtgagaagacaaataatgggagagcccacatatgttggaattcatttgatggtatctaagctggggtgattgtccccactagcattacatgactatggatccagttatttggagaaatccatttcctccacagggaatatatactacattagaaccaaagatggaatccttagtaaatggaatcatttggcaaaattcagttgtctgaaatttttgcataaaattctcttttttattttcattgagccaaataaataaagtatcaggtatttactggggtcaccattctttgattcattgattttttttttcagacaggatctcgctgtcacccacgttggagtgcagtggcataatctcagttcactgcaacctccacttcctgggcttaagtgattctcccacctcagcctcccaagtagctggaaatacaggcgcgtgccaccatgcctccattttctttctttttttttttttttaattgatcattcttgggtgtttctcgcagagggggatttggcagggtcataggacaatagtggagggaaggtcggcagataaacaagtgaacaaaggtctctggttttcctaggcagaggaccctgcgccttccgcagtctttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtatagaacaaaatgaaaagtctcccatgtctacccgcctctacacagacacggcaaccatccgacttctcagtcctttccccacctttcccccctttctactccacaaaaccgccattgtcatcatggcccgttctcaatgagctgttgggtacacctcccggacggggcggctggccgggcggggggctgacccccccacctccctcccggacggggtggctgccgggcggagacgctcctcaattcccagacggggcgactgccgggcggaggggctcctcacttctcagacagggcggttgccgggcggaggggctcctcacttctcagacagggcggttgccgggcggagggtctcctcacttctcagatggggcggccgggcagagacgctcctcacctcccagatggggtcacggccgggcagaggcgctcctcacatcccagacggggcggcggggcagaggcgctccccacatctcagacgatgggcggccgggcagagacgctcctcacttcctagatgggatggcggccgggcagagacgctcctccctttccagactgggcagccaggcagagacgctcctcacttcccagacggggtggcggccgggcagaggctgcaatctcggcactttgggaggccaaggcaggcggctgggaggtggaggttgtagccagccgagatcacgccactgcactccagcctgggcaccactgagcactgagtgaacgagactccgtctgcaatcccggcacctcgggaggccgaggctggcggatcactcgcggttaggagctggagaccagcccggccaacgcagcgaaaccccgtctccaccaaaaaaatacgaaaaccagtcaggcgtggcggcgcgtgcctgcaatcgcaggcacttggtaggctgaggcaggagaatcaggcagggaggttgcagtgagccgagatggcggcagtacagtccagcatcagagggagaccgtggaaagagagggagagggagaccgtggggagagggagagggagggggaggggagggggagagggagagggagaggtgcattttcttataaacccaatttcctctttagtgcaactctaccatttgaaaggaacctttctattgtaatttacaagctgtgaataaccgctatgtaattctttccaaggattaataaactgagagaggatttgaaccaacagaggtaggggaagattagaagggggatgcaagtggccacagatcttagaggcggccagcagagggcgctgctccaaggtgaaggtcgcaccctgagaggccatccttttttgtaggaccagactggggtgtaaggacagtgcctcatcctcacaacgacagacccgtgttctgggtgtggatttgcctcccttgcctgcgggacttctgctagcactgccgttcctagacttagaccatgctagaatgagtccaggaaccgaggagaggagatgggagtggctcctcccactgtggcccctaataattcacatgaagaatttttgctttccttgccagggacccgggactcagtgggtccagaggtcctagtgccaaaggaagaaatgtgtagatcaggaaatactattatggttttattcaactggaagccgaggctggccatttattgtatttatttatttatttatctatctatttatttatttatttagagacagaatctcactcttgtttcccaggctcccaggctcaagagatcctcctaccttagcctcctgagtagctggtactacagtcgcatgccaccttgcccagctaattttttttttttttgagacgcagtctcattttgttgcccaggctagagtgcagtggcgcggtcttggctcactgcaacctccacctcctgggttgaagcgattctcctgtctcagcctccggagtagctgggattacaggcatgtgccaccgcgcctggcaatttttttttttttagtagaggcggggtttcaccatgttggccaggctggtctcaactcctgaccttgtgatccgcctgcctcagcctcccaaagcactgggattgcagacataagccaccgcgcctgttttttttgttttgttttgttttctgacagagtctctgtcacccaggctggagtgcagtggtgtgatctcagctcactgcaacctctgcctcctgggttcaagcgattctcctgccttagcctcccaagtagctgggattataggcgcacaccactatgcccagctaatttttgtatttttagtagaggtggggtttcaccatgttggccaggctggtctcaaactcccgacttcaggtgatccacccacctcggcctcccaaagtgctgggattataggtgtgagccatcaagcccagccctgcccagctaatttttacactatgggcaagtatgctgcccaagagtgctctggaactcctgggctcaagtgatcttccttcctcggcctctcaatgtgcttggattacaagcatgagccaccttgcccagccgaagctggccatttaaagttcctcatgctgctgaatcaataaggatggaaggcggctactattatgggctaagtgtttgcatcctccccaaattctttttttttttttttttttgagatggagttttgctcttgttgcccaggctagagtgcagtggcgcgatctctgctcactgcaacctccacctttcaggttcaagtgattctcctgcctcagcctaccgagttagctgggattacaggcatacgccaccacacccggctaattttgtatttttagtagagatggggtttctccatgttggtcaggctggtctcaaactcccgacctcaggtaatctgctgacttcagcctcccaaagtgctgggattaccagcatgagccaccgcgcccggcccccaaattgttttttgttttttttttttgagacggagtctcgctctgtcacccaggctggagtgcagtggcatgatcttggctcactgcgagctctgcttcctgggttcacgccattctcctgcctcagcctcccgaatagctgggactacaggcgcccgccaccacgcctggctaattttttgtatttttagtggacacggggtttcaccgtgttagccaggatggtctcgatctcctgacctcgtgatctgcctgcctcagcctcccaaagtgctgggattacaggggtgagccaccacacccggcctcggcccccaaattcttatgttgaagccctcacctccatgtgatggtattagaaggtggggcctttgggacgtaattaggctgacagtgccccatgatgggatgagtgtcttaaaagaaaagaccaggtggtctggctagtggctcacccctgaaatcgcagcactttgggaggccaaggtgggtggatcacttgagatcaggcgtttgagaccagcctgggcaatatggtgaaaagccatctctactaaaaatacaaaaattagctgggcgtggtggcgcaagtctgtaatcccagctacttgggaggctgaggtgggagaatcgcttgaacccaggaggtggaggttgcagtgagcccagatcatgtcattgcactccagcctccaacctggacagagagagcatctggagagtctctgtctcaaaacaaaaagaaaaaaaaaagaagagaccagagagcctttcttctctttgtccaccaagtgaagatatggcaagaaggcagccatctgcaagctaggaaaagagcccttgccagcacccaattgtgctatcaccctgatatgggacttcccagcctccagaactgtgagtaatcaatgtctattgtttaagccacccagtatgtaatactgagctgactaaaaccatcaccgaactagcctctttacatatgattagcaagaggaaaatggctctgttacttaatggaggaaggaggctatgtctgaaagccaaaaattcactggggacacatcttagcaggctcttgaccctaagacctggttaatggaaaagtagagcaacccaataaaaacaagaccaccaagaagtcaggtcttatggaataaagtattgagtgtccctatgaggcacagaacccttcgaaaggggattggaagaagtggtgaagaaggcggctatgattatcaacttagacttcatcgccatttgtagaaggaggcttctaacagctatgttttatgttaattggctcttttctcttcttttttctttcaaccttatattaagagcactggcagaagctagcggttttggcatcctgtaattattagctgtataaccttggccaagtaactcaacctttctgtgcctcagttactcatctgtaaaacagggtaataagtctcaacctcgtacttatgttgttataaagatttaacactaggctgggcatggtggctcacacctgtaatcccagcactttgggaggccgaggagggtggatcacctgaggtcaggagttcaagaccagactggccaacatggcaaaaccctgtctctactaaaaatacaaaaaattagctgggtgtggtggcacgtgattgtaatcccagttactcgggaggctgaggcaggagaattgcttgaactaaacctgggaggcggaggttgcagtgagccaagatcgtgccactgcactctagcccaggcaacagagttagactctgtctcaaaaaaaaaaaaaaaaaaaaagtaacactttgaacaaaaaagaaaaaaataataaaatttaaaaaagatttaacaattgggccaggcatagtggctcatgcctgtaataccagcactttgggagcctgaagagggaggattacttgaacccaggagttccagaccagcctggacaacaaagcaagactttgtttctacttaaaaaaaaaaaaaaaacaccaaagtcaggtgtggtggtacacacctgtgatcccagctacttgggaggctgagatgggaggatcccttgagccttggaggttgaggctgcaatgagccatgatcataccactgcactccagcctaggcgacagagtgaggcccatgtcaaaaaaaaaaaaaatgatccccaacatttagcagcttaaaacaaaaaacatttattatatcacactttctgtgggccaggaatctgggagggacttagctgggtggttctgctcagttctcttgggatgtttcagtcaagcagtggcctggggctgcactcttatctgaagactcaattgggagaaaatatgcattcaaggtcactcattggttgttggcaggctgtagttccttactgaatattggttgaagacttcattggcttactacctggacttctccatagactgcttgaatgtcctccccacatagctagagtgaatgactaaaaaagagagagaacacacacagcccaggtaagagttcagtctttctaagtcattatatgaaagagattcttttttttttgagatggagtctcgctctgtcgccaggctggagtgcagcggcacgatcccagctcactgcaacctctgcctcctgggttcaagtgattctcctgcctcagcctcccaagtagctgggattacaggcgtgtgccactatgcccagctactttctgtatttttaatagagatggggttttaccatgttggccaggatggtcttgatctcttgaccttgtgatccacctgccttggcctcccaaagtgctgggattacaggcgtgagccaccacgcctggccgaaaaagattcttgcacacacatgtttatagtagcactattcacaattgtaaaaatgtggaaccagtccaaatgcccatcaatcaatgagtggctaaagaaactgtggtatagatatacagtggaatactactcagtcataaaaaggaatgaattaatggcatttgcagcaacctggacaggattggagactattattctttttttttttttttttttttttttgagatagagtctcacttggtcacccaggctggagtgcagttgtgcaatcttggctcactgcaagctctgcctcctgggttcacaccattctcctgcctcagcctcccaagtagctgagactacaggcgcctgccaccacgcccggctaattttttttttgtatttttagtagagaccgggtttcaccatgttagcctggatggtctcgatctcctgacctcgtgatccgcccacctcagcctcccaaagtgctgggattacaggcatgagccaccgcacccggcctattttttttttttttttttttttttttttttttttactaaccaggggtttaacataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaataaagaagattcatgctaagctgtggcagaggggggaaggtatgatcgggtgggggtgggataaggaatggccatggaagataactgggtcaggttggaccctgggctgggagggggagggcaaggcccctcaccacaacttaagccaaacctaagctgcccccaggtgccataggtccctgtcccagcagggaggctgatgggcctgggcccatgcccctccccacctttgggggtcagatagtggccacccaggtttgctgggttggggcctgatacaggctctgcatgcccattcgggctgcctgtggagagagaatggagtcactgtttaaccatgctacctgcctcagccccagcagaccacaggaggttggccccagactcactgagtgcctgcagcagccctacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttgggaccctaacttgtcccttgccaaggccaactggctgccctctggctgtggggaccgcaaggagggacccacaagctgctggcgaagtcgctgcttcagttctggcttgagccactccacagccacctgctctccacagaggtgtggctgcccttcctccagggcctttttggccatggcagcggtccagtgcgagctgaatttgagcagagcgatctgcccgggcgcaggtccggggctgggcagcagccgcgcctcctgcaggccgggacccagcggctgcagcgcgggcagcagcgcgggcagcagcgcggtgcgggtcagattcggcggcaggcagtcaacgctcagctcacacttcccggtgctgcggcacacgagcagcgggcaggacggccgcagcgggtggttgtgcagcgggcgatggcggcctgcgcgccgcgccgcgagctgcagcgggcatatgcgaagccgcggttcaggccgctgaaggtcatcatcaggcggaactcgtagaggcggcccacgcgctggaacagcaggatagctggtgctcatacacttcctgaggcagccgcccgatgaacacctctgacccagccggcggcgggctgcccacccagcctgggggtggcccgccatacttcctctgcccgttcacctgcaccaggcgatgcctgtctccctgacccacgcctccagcgccgccttcaccctctcacaccacagctcacaatcccgcttggactgcatggctctctattctcttttttttttttttttttttgagacgtagtttcactcttgttctccaggctggagtgcaatggcgggatcttggctcaccgcaacctccgcctcccgggttcaagcgattctcctgcctcagcctcccaagtagctgggattacaggcatgcgccaccatgcctggctaattttgtatttttagtagagacggggtttctccctgttggtcaggctggtctcaaactcccgacctcaggtgatccacccacctcggcctcgcatagtgctgggattacaggcatgagccaccgtgccccgtctatggagactattattctcagcgaagtaactcaggaatggaaaaccaaacatcgtacgttctcactcataaatgggagctaagctaggaggatgcaaaggcataagaatgacacagtggactttggggaatcagggggaaaggatgggaagggggtgagggataaaagactattaattgggtgcagtctatattgcttgggtgatgggtgcacacaaatttcacaaatcaccactaaagaacttacttacgtaaccaaacaccagctgttccccaatatcctatggaaataaaaatttttttttagaaaaagagttcggtctttctgtaacctaatcttggaagtgtatattatcacttcttccataggctatcagtctcccagaccaaccctgctacagggtaggggagactacatggtatgtgaataccagaaagtgggggccactggggactggctatttggaggatggttactacaaactatatttgtaattttttttttcttgagatggagtcttgctctgttgcccaggctggagtgcaatggcacgatctcagctcgctgcaacatccacctcctgcgttcaagtgattctcctgcctcagcctcccgagtagctgggattacaggcacgcaccaccacacccagctaattttttgtatttttaatagagatggggtttctccatgttggtcaggctggtctcaaacgcctgacctcaggtgatctgcccgcctcggcctcccagagtgctgggattacaggcccgagccatggtgcctggctatatttgtaatattttaaccactaaaaaaaaaaaaaagaagaagaagaagaagaaaaagaaacaagtatgggaaaatattaagatctgataaaaccgggttatacttatgcaggtattcattacattattctccataactttttaaatgtttaataataaaagtaaaaatattttccccttaaaaatgtgcagagcatacctcaaataatgttgacaaagaatcctaaagacaattattattattattattttttgagacaggttcttgctctgttgcccaggctggagtgcagtgatgccacctgagctcactgtaaactccgtctcccgagtttaagcaattctcctgtctcagcctcctgagcagctgggactacaggcgagcaccatcatacctggttaatttttatattttcagtagagacggggtttcatcatattgcacaggctggtcttgaactcctggcctcaagtgatccacccaccttggcctcccaaagtgctagcattacaggcatgagccactgcaccgggcctctcaaactcctgacctcaggtgatccacctgccttggcctcccaaagtcctggcattataggcgtgagccactgcgcccggccgatcttccttcctttctcccttcccctcttcttcttcttcttcttcttcttttttaattaatagagatgggattttgccatgttgcttaggctggtttcaaactcctgggctcaagctatctgctcgcttcagcttcccaaagtcctgggattaagggcgtgagccactgcgcctggccccagtaaggatttaaaagctcaggaattattagtcagcttccttttttgttcatcctgttgtttgttcatttcagtctattccctttttataatttccttcttcataaggactatttctccttgtacttttgtgagaattcccgtaacttgtaatcccagctacttgggaggctgaggcaggagaatcacttgaaccgggaggcggaggttgcggtgagccgagatcaagccattgcactccagcctgggcaacaagagcaaaactcggtcttggaaaaaaaaaaaaaagaaaagaaaagaaaaaagaaaggaaggaagatcctcattggacagagcaaaaagcagaattgatggcactgaaaatgaaatcagcagctgatgtacaagttccagaatgtctcctagagtaacaaggaaatccgggtgtggtagtttatgcctgtcatccaagcactttgtgaggccaaggaggttagttagcttgagcccaggagttggagaccagcctggccaacatggtgaaaccccatctctacagaaaatataaaagttagctgggtttggtggtgggtacctgtagtcccagctactctggaggcgaaggagggaggatcacctgagtcccgcgaggtcaaggccacagtgagccttgatagagttttgccactgcactccagcctaagcaacagtgagaccctgtctcaataaacaaacaaacaaacaaataaataattgtagagacagaagataaaatggagcccggtgcagtggctcacgcctgtaatcccagaactttgggaggctgaggtgggcagattacttggcccaggagtttgagaccagtctgcccaacatggtgaaaccccgtctctactaaaaatacaaaaattagccaggcatggtggtgtgtgcctataatcccagctacttgagaggctgagacaggagaatcgattgaacccaggaggtggaggttgcagtgagctgagatcacaccactgcactccagcctgggtgacaaagccagactctgtctcaaaaaaaaaaaaaaaaaaaaaaggctgagcacggtggctcatgcctgtaatcccagcactttgagaggctgagccgggcagatcacctaaggtcgggagtttgagaccagcctgaccaacatggagaaaccccgtctctgccaaaaatacagtattagcaggtcgtggtggcacatgcctgtaatcccagctacctgggaggctgaggcaggagaatcgcttgaacctgggaggtggaggttgcagtgagccgagattgtgccactgcactccagactgggcaacaagagtgagactctgtctcaaaaaaaaaaaaaaaaaaaagagagagagacagggtttcaccaggttggccaggctggtcttggactcctgacctcaagtgatctgcccgcctcagcctcccaaagtgctgggattactggtgtgggccactgcatctggctcccaccatctctattaaaataagataaaataaacataaaataatgaaccgacaaaataataatacaattcattgtaagtaaaatgctatcctgagttctgtgagtcattctggataattcaaattctctagaattaccacctcagctgactttttttttttttttttgtagagaccaggctggtcttgaattcttgagctcaagtgatccgcttccctcagtctcccaaagtgctggaattacatgtgtgagccactgagcctggcctacaaattctttattatacaacacacagtagatgctcaataaatatttgctaagcagaaacatacactcaaaataccagaaattatcaaggaagttgccagttggtctcttgggttcttcctcccgacaggtatacacacctattgtaaagatgaacacattaggctgtgagaaaccaatactgttaaacattccaatcaggtgacaaactccctgggctctggtttatattaccaagcaacctgatgataacttggcttcctgtgtggcttgtttatagaaagagaatgctacccaggctgacgtgagttgcatttctgagttgatttctcactgtaaattaataaactggcattctggctacatagatcagtctctttgaactctttgtaccttccaccattagtgtgatttctaaggctgcaagccagacactgcccaagacccagcactggactctggtgagttcttccagctgttgccaccccaggaggctctgggagcccctgggaaccatccagcttgctctctgtctctacatttcagggtgtgggtttcagggcattcacaacattcctgcaacagaagagttttgggaacacccccagcaggatgtgggtgatttgaatgtatgtcagagatgtggttgtaactgagaaatcttaagcctagtgaattttattccacttgacttaaataaagagcacgtgaaagaaggggatctgaggacatctatgaacagggccccgagggcatgaacttactagtgtttatatgactagtgtttatctgggcctgtctagtctggagaacctgactctggtgtacccaagctttgcagtggctgtagaggtttgctcttttggagggagaagataattcattcctccaacacctgaatgagggtagattaacccacctccttcagctgcaatttggcaaatttctcttctttgatttaatgctcaacggacaaatttcctttcttcttcttcttcttcttcttcttcttcttcttcttcttcttcttcttcttcttcttcttcttcttcctcttcttctttttttctcctcttcttcttcttcttctcctccttctccttcttctccttcttcttttctcttccttctcctcctccttcctcctcctcctcttcctactcttcttcctcttcctctcctcctcctcttcctcctcctcttccttcttcttcttctttctttttttttcggttttgagacagggtctccgtcacccaggctggagtgcagtggcacgatctcggctcactgcaacctccacctcctaggctcaagcgatcctcccacctcagcttcccatgtggctgggaccaaggcgtgagctaccatgcccggctaatttttgtattttttgtagagacagggtctctccatgttgctcaggctggtcttgaactcctgagctcaagagatcctcctgtctcaggctcccaaagtcctgggattacaagcacgagccaccatgcccggcctcaacaggcaaccttctgattaataattagacctctgtgccggccgtcgtggctgatgcctgtaattccagcactttggaaggccaaggcgggtggatggcttgaggtcgggcgtttgagaccagcctggccaacacggtgaaaccccgtctctgctaaatatacaaaaattagcctggcatggtggcgtatgcctgtaatcccagctacttgggaggctgaggcacgagaatcgcttgaacccgggaggcagaggttacagtgagctgtcatatataatgaaacagttttactaaacttaggaagcagtgacttggtgtctctagaaattgcctaacatacacattccaggatacattctctgtcatctggaatctcctcccttccacaaacccacgctgtcttaagcactattttcctatttgttgttgacctaatctagaaaaaagcggccatcactctttctcccccactcagtccctcagtcccgaaacacccttattctccgcacttgtcaccccaccctctgctgcccccaccgcagcgcgcaaacgcacacgagtttaaagtttaggctgtgatgctatcctcgcccgcagatcacaggacagacattctcggggacaactttgcgaggccatgtgctcgtcccccttaggaaggaagagggagaaatccctgcggctcggttttgttccaatggtctgctcagcgagtgattcccgtttccccaaaggctgcccctcattagcatgaacggggacgcgggtgtggagaaggggttagaggagagaaagcaagcaaaagcccaggctcacttttagagcctgggaaccctgtctgcaaaaatgacagctagagctttctggctcctctgtttaatcgtcggatcatcccccgaagctccggtggagagaaaaagtaagatcggtgtagtgcggagccctgggagcggagcggggatctggggagggggcgcccaggcctcagccgccggccgacaaccgggccaccttccgtgaggccgcacacgctcccacaggcccgcgcctggcgcaagccgagaaccgcgcgtcgccgcgccgcgggcccgcgacggaggaagccccgagacgcgcgcgctcacgggccctacgcttccccgccgcccggccgcgcgcgcgcgccgccgagggccccgccggccctgcccaccccaaccggccgcgcgccgttgtgccggcccccggctcgccgcccgcgccgccgccgcgcctcagcttcagattcggcctcagtcagccgcgcagggacgcggagcccggcgccgagctctgcgcttgcgcttgccgggcgggcatggacgggcgagaggcgttctgcaagcgcgaaatcggtgagcccggccgccgcgccgccgccccgcgagcctttccgagtcccggagaatcctgcacgcgagatcccagggcgcccgacccatgcgggccgtttcgctgttgctaaaaaccaacgcccagggactgggagaggaactggggttcccaaactgttttttggaagcagcgatgaacgggatagtgcatgacgtggacgtgctgggcgcgggcatctggctggtgaccctgctggtggatcgggacgggctgtacaagatgaaccgcctgtacctcactcacccccgacgtcttcttcttccgagtccacatgttagtcctggactcctccagctgcaataaaccgtgtccagagtttaaacctggtattgaaactgagctgaatgacgctgcatatgtactttataccaccgtttgtaacgtgggtgccacagcccgggctgtgggtcgtccagtctttttttgggacggatgggggacagtattgtaacatgattaggatttagacgacaggtattatttccgccactgtgatttaagcaccgtcagccccacccccacgggtgagaacggcagctgttggcacaaagcgggctgtcaataaatagatgttgacaaatggagtgagcgaccaccaaacaccattgccagaagggactgtacagaactgagtttagaaaagctgcttttttgggggagtgtgtggagggttggtagcggggaatacccactcccacatcttttttttttttttttttttttttttagacagagtctcgctctgttgcccaggctggagtgcaatggcgccatctcagctcactgcaacctccgtcccccaggttcaagccattctcctgccctcagcctcccaagtagctgggattacaggctgagccactgcgcccagccccactcccacatctttctaggcatgtgctctgggaaatcctgatacaatgtgataaggacctttgttctgtaatgtgggctggttacgtattgctttcccttccccacaccccgtgctactttttgtatttttagtacagatggggtttcaccatgttggctaggctggtctcaaactcctgacctcaagtaatctgcccgcctcggcctcccaaagtgctaggattaaaggcgtgagccactgcactggcctggttgggttggttatcttctaaaggtcgctagactgtttccaccttgcctgtagactaaatatcagtttcaacttgtgcagcaagatagtagattgcagcttaggtatttcttaaaggccttatattttctgtttcatggcatttaaaagacgctatgaattaatgttctggttattttgtccaggcagcaggtatattgtgatgggccacatctaccataagagagggcagcttcctacagctctgctccaggtcctgagaggccatctctgtccaggggatggactgctgaggagcagcagcagctatgtgaaaaggtttaacccaaaaagggaagggcaaattcaaggtgcaattcatacccaatgcatttgaaacaaccatcctggcatttctggatcacaagagacatcggcaacaagacatgaaaggtctatcttcatgtaatgggtcctcctttagaagagagcccaaagctactctatgaatgacctgcatagttacaactgtaatctcgaaggtgtcactttgttatttacaagatgcttcttaaatgggctgctcctgagctcagtgtcaaggtgattcaactgttgtgccagacagtgatttacacagctcagataactgacctgtctagttaacagatcactgcttcatgtttttaaatattttaatttaatacattctttagtagaaatagtccacaaaacattttcctgaatttaaatacacaacttttatatcatgtatcaaacctgattttatattcaaacctgatttatattcaaaacttatatgtgaagattaaattcttcacataacagtaagcgcactagtcaaaagacatttacctatgaaacgtcatttagatcaaacacaagggtcaaagcccaggacaaggattaaaattttacacttaaaaagtaccaagccgggcgcggtggctcacacctgtaatcccagcactttgagaggccgaggcgggtggatcacctgaggtccggagttcgagaccaggctgaccaacatggaaaaaccctgtctctactaaaaatacaaaaattagccgggtgtggtggcacatgcctgtaatcccagctgagggaggctgaggcaggagaatcacttgaacccaggaggcagaggttgtggtgagccgagatcgcgccagcctgggcaacaagagcaaaactccgtctcaaaaacaaacaaagtgtacaaaagggccagtgtgcggatgggtggattaaaaaaataaattttaaaaaagtgccaaagggcttacttcaggcaaaagtgttcctgatgtaccaaagagtaagatatagtttattttcatgcctccctgctcctaataatgtatgttttgtgctgaactggcagctatcccaatgtgaactgtattctgagtgtatctgatatcatttttctattaagaccaagtataatgtttgcttgtaaagcaataaatcttgctttgaaattagaccttggatgcacctgtttatttttgttttgttttgttttagcctttgagccctaaaggtttgagaaaaagcctttctcaaattcattccccaaaccttggaaccaatattaaccaatgacagctcacaagcaagtgaattctaaacatttttcagttggttttaaaaaggtttaatcactagctaaattaaatattgattttatacctgagtccacaaagacatgagagtattttttcagaagataaggctgtacttcagtttataagaagtacggtgaacagagacaccactaatgcatagatgaagatgactgcctaaagagagacaggggaaggaatttcactggagagagagcagcctatttggcctcacggtgatgcactcaggaaggtcagaatgtgtcctgacgctgtccatggcacccagtagtagcactgtacacataaaggacatccaggacgggacgctagggaatcacaggagccaagaggcaacagcctaacattacaatacctgatactattatttgttccaattatggggcagacaggtaataaagagttgagaggttctgagtgttctatggtaaagcactactgagagatttctagagtattttccaaaaatgagttttgtccaaatttattataaattttactagaattgctttttgggagtcagatgcattattgcatgatagaattatagctaatgaagagcttctgagctagttttctttaagataaaaaaaattaactcaggcataactcaggccagtcaaatcaaagttgaatttttaaatgtcaaaaggctaggccgggagctgtgactcacacctgtaatcccagcactttgggagaccaaggcgggtggatcacaaggtcaggagtttgagaccagcctggccaacatagcgaaactctgtctctactaaaaatacaaaaattagctgggcatggtggtgcatgcctgtaatcccagctattggggggcaggaggatcgcttgaacctagtaggcagaggttgcagtgagccgagatcatgccactgccctccagcctgggcaacagagcgagactctgtctgaaacaacaacaaaaagtatatctatatggctaatttctttagttgaatttggttcaaattggatcaagtggtataatcttctaagaaaagtcttttagtatctcactccaagtatctagaaataccttagaatgtttcaaattattaaaaatacttctcggttggctcttccctccacctcctcaagtacttcattattttatccatggaatatccccattctcacattaagggcaagaaatctgagacctatggtaatagtttcttttttttttttttttttgagaaggagtttcgctcttgttgcctaggctggagtgtaatggcatgatgtcagctcaccgcaacctctccctcctgggttcaagtgattctcctgctctagcctcccaagtagctgggattacaggcatgcgccactttacctagctaatttttttttttttttttttttgtatttttagtagagatggggtttctccatgtttgtcaggctggtttcaaactcccaacctcaggtgatccacctgccttggcctcccaaagtgctgggattatacgtgtgagccaccacgcccagccgtatcatgatagtttcaatcaggaagagtgaaagctgtaataaccatgtaactttgtctaactaagtgtgcagagatctgaaagtccaccaggttggctctttaacataaagaagtagagagtttgcctaaaggaattagcagaaatagggaaataacttttatttgcagatcccaggaaggtagattacaaacaacagcaaatcttagtgtctctaaataacactctaggccatttggaatataaaaaggtaattattttacttcagaaaatatctccaaaagttcactttttttttgagacagagtcttgctgtgtcgctcaggctggagtgcagtggcacaatctcagctcactacaacctctgcctccccagttcaagccatcctcccacctcagcctcctgagtagctgggactacaggtgtgtgccacttgtccagctaaattgttgtatttttagtagaaacagggtttcaccatgttggtcaggcaggtctctaactcctgaccttgtgatctgcccgcttcagcctcccagagtgctgggattataggcgtgagccaccatgcccagccacaattttatttaaacctcctgtagaatttggataggagaataaaagctttaccaataggaaaatacttttcatgaaatggtttcaaggattgtgaacttggcaggtgaagcataacagttattgaaaatacttttagccaaggaaatctactgatgcaaattaaatatatttacaagcccaaggcctgtggtagaaacatcctaagagtatcacaaatgtacagtttactgcctggattattgaaagcaaaatagctgtgttatatagatcttaatagcagaagctttcaaagattactcacagaaaagcagctttcagaactcattatgttctaaaaaatgtatgtttttctttcttttttattttttttgagatgaagtctcactcttgtcccccaggctggagtgcaatggcgtgatcacggctcactgcaacctccgcctcccaggttcaagtgattctcctgcctcagcctccctagtagctgggatttcaggtgcctgccaccatgcctggctaatttttgtacttttagtagagatggggtttcaccatgttggccaggttggtctcaaattcctgacctcaggtgatcccccctgcctcggcctcccaaagtgctggggttacaggcgtgggccaccacacctggccaggaatgtgtgtttttcaaaaattacttttgaaagactaaagccctatagttgataaaactataaaatgtctttatgtatttgtatggtgatagaaactgtaaaacactttataccattaaatacacatgaaattaatatcttcctggtctcaggatttccataaaatttaccctttttaatttggcaatgctaacagctacagaagacatattaccaccaaccaaccgttgcttcattagaaactgcaccaaatccaatgtcaaaaacattactttatttttctagtatgaaatgtcctattacatacaaaagaattgctgtttagaatttgccacaatttgttgaaaacatagcaatctattgcctacaggtaggaaagttcttgctgcaacaaattttaaatgattaagcccatatatatttctatatatatgaataaatagtgcagaaatactgtgacgtgatgagatgcagaataattttataattcattaaaatgtagaattcttgcatcagcacagtgcatacaatatgtaactttttttaaaaagtaaaaggacaaaataatccatatttaagtatttccatcttaatattttaagcaaaaatgttttcatgttttcatattgagtgattagtctctttagtttgtaaacataggtttaagtgacatcttcatgtacaaaaaggaatgggcttcattagataaaattaagccagaataacctgtacacctgagcctgtaataagaaagaattgggaactgtagcaacatctttcttttaagaaaccaaggtctgggaaaggttttgcatagcagggaaacgttgaaaggaaggaaacttttaaaagcaataattagataaattccagaagttgataggacaaagctaatatgagttagaataaaatctagtagaatttttgcaaagctgcataatccagctatggcagattttatagaagctattaccacaatgcagtaatacaatgtgtaagaacattgaaaggaagaacatgcaaaatacatcttcctcattttcttcctactgcttacactacttttccttacatggaagaaacaaacaaaccaacaagcaaaaaacaaacccaatcaacaaataacacagaggatgagatcatctaacaaaaaatgtccttcatacaatataagtagctgtctgtaattggtaatttgcccagtatcacagaatgtacagatgaaggcaatgtgtatcttgtcgcattacctttttcgttagtatgatcaactgatgcgacaggattagcacccctgaagattcttctctgacgtgatgacaattgactgggaatgataaaacgaggggccactgctgtccaggagaattccaggtacaattagattcttttgcctttcatgaccttgcagccctccctccccacagaggcttacagataatcattagcacacattcaaagacacctctgtctgtgggagaaaaactatctccatttattttgtttcacatacatccatagttgaattttaatacaaaaagaaaaattagaatctgacaaatgtttacaaagaagataccttcaaatagattttactcatttcaacctggtgtggagtaattgacaaattgtactgttatattcaagtcaccagagtctgtagtccaggaccacttagcccaacctttatgcaagcttgattttaatctaccatgaacaataaactcattgttgattcgcagttgtgtgtgtgtgcacatgtgtacatagcagctcctttcatagaaagaaaagacatctagaggttgtcttgtacttttacgtacaggaatcattgataagatatggatggattatatgtaaccgtggctggattttataagaaaaaataattagttgacaaatgagggcagcaataaaaaagcatcttttttgcaacaataaataaatacagtcaaaagttttctttgagactctaaaccagcttcttcactgaagagcagacgtggcatttccatggagttatacttgaccccacagtatcattgtttcttgctttctttttcttttttttttttaataaacaaaattttctcgcttctgccacaataataaaaccatttgatcttgacaagataatggtgtcgttgacttttcttttttctttttcttttcttcctttttttgtttttgaaacggagttttgttcttgtcacccaggctggagtgcaatggctcaatctcggctcaatacaacctctgcctcccgggttccagcgattctcctgcctcagcctcccaagtagctgggattacaggcataggccaccatgcacagctaattttgtatttttggtagagacggggtttctccatattggtcaggctggtctcgaactcccgacctcagatgatccgcccgccttggcctcccaaagtgctgggattacaggcgtgagccaccgcacctggcaactttgcttttttcttgtccattggacaaaattggccaataatataattggactgttatgaccaataaaaacaaagtttaggtcaagtcttgtcaggatagcctcactaaaaagatctggctccttaatttaaaatagttcaggcaacaagattcttgctgtgttttatgttaggttaacatgctgaactttaggaagctgtagactgcagtttgttgttgtgagacctacagagtatagaaaaagggaacaattgagcacctttcatttttgaaaatgatgctttatgcggatgccaaagtaaataaatctggaagaagcagccatgttctttcattcacccttggcaagcgaatagaaaagaacgattaagaaatttttaacctataataataaaacttttcactgtacactaagcataatagctcactggaaaaagccaatatttaaaatatgtatgtatatatatttgtctaataaagattacaacattttcaggcaactggacaaatagagacatttacagaagcattaccattgtggtgaaaggtgcgtgtgtgtgtgtatgtgtgtgtttatttacacggatgaggggaatataaagggaaaaattatgctaaaacaaaagaaaaagcaattttaaaatcatatttttctattaaagtccagaaagtctcccagtttcacacagttttattcacaattttttttttttttgagacgaagtctcgcttttgtccccaggctgtagtgcaaaggcgcgatcttggctcactgcaacctctgcctcccagattcaagcgattctcctgcctcagcctcccgagtagctgggattacaggtgcctgccaccacacccggctaatttttgtactttttgtagagacgaggtttcaccatgttggccaggctggtcgcaaactcctgacctcaggtgatccgcccgcctcggcctcccaaagtgctgggattacaagtgtgagccaccaaggctggcctcacaacttttgtcagtaaaccaaattactgtacagttaccaggactaagtcaaaggactttatattgcaatagcagataaatttatattgcaatagcagataaatacagtattccaatagtttacaatttttaaatacattgtttcacgtggctgctagaataaattttttaccactatacatcgttaacattaaaaaattatattagctaacctgactttttggggggcaattttggattacgtaatcacaaggtacaataaaacagtgaccccaacatccagttctgattccagttaaaaatttagactaaagatatcacaatccgtaagaaaagaaagaatatggatggtataaatgatgaattataacaaagtgcagtaatgaaaacaatgtgcaaacaatgctggagatcataaattacaatgggaaaatatggcaaaggaaattctggaaacccataataaaatcaagtttcaataactggctagttatgtttcattctaccttaaatctggaaagcaatagaaattccctaaaaatgcaacagcaagttgtctttatacaattctttgcattgtaatttttttctttttttctttttttttttttttttgatttgtttgttttgagacagggtctcactctgtagcccagtctggagtgcagtggcacaatcatggctcactgcagcctcaacctccagggctcaggtgatcctcctacctcagcctcctgggtagctgggactacaggcacgtgccaccatgctcagctaattttttgtattttttgtagagatggggtttccccatgttgcccaggctggtctcaaactcctgggctcaagtgagctgcctgccttggcttctcaaagtgttgagatcacaggtgtgagccactgcacacagcctaatttgtttatttaagcagaattgagcaaacgtctccattcagctcccatgtgctttattgaaaattatgtcaacttcagtatattaaaaagctacataaaataaccaggtggcaagaagacatcctaagtggcccctacactatgcgggcc

SEQ ID NO: 25 - DNA, 633421 bp, Homo sapiens
aatccattctgaattggccaaaatatccaacactccatcacagaaaagtatttgcagttacctgataatgccaggctctttcaagcctatgctgcattacacattactccctacaccatgcttcagcaagtccataagactcagaaaaaagtccatccttccctaggaaactacctttactgactccctccagcactcccattttatgcttgttggaagaacaagaagcactcaagaaaagatagatacctggttctacttagtctttcagacacaaagtgcagtctggaacaatgacaattagcttttactaactttcattatctatcaaacattgttaaaagcaaattataaattttaaattaactttgtaagaaggctagaaatcaggtagtaggaggagagtgtgactcctccaatttggttcttgtttttaaaaattgttttggctactggccaggtgcagtggctcacgcctgtaatcccagcactttgggaggccgaggcaggcggatcacttgaggtcaggagttcaagactagcctggccaacatggtgaaacccccgtctccactaaaaatacaaaaactagctgggtgtggtggcacacgcctgtaatcccagctactcgggaggctgaggcagaagaatcacttgaacccaggaggtggaggttgcagtgagcccagatcacaccacagaactccagcccgagtgacagggagagacttcatctcaaaaaaaaaaaaaaaaaaaattgttttggctcttgaaaatacttaacatttccatacatacttgaaaatcaatgttcaattgttaccaaaaacaacacaacataaaccaaaaaatcttgctgggatttttcactgggtttgcattgaatcattgtgtctaacattgactcttctaacacataaatacagcatacatctccgttcacttatgtaatctttttcagaagttttatggtttcagcaataaagtcattaacgtcttttgttagatttattcctaagtattttatgtttcttgatactaccgcaaatggaactgtttctccgggttatttttcagttgtttgctctaataaataaaaatagaattgacttttatatattgaccccgtacctggagaccttggctaaatctctaattctcacaggtttagggaattccatggggtttctaagtatcatatcttcaaatacaagcagttttgccctaccttttccaatttccatgcctttaattgcttttttcttgcaatattgcattagccaagacagagtacaatgtttttgtttgtttgaggcagggtctcaccccgtcgcccaggctcaagtacagtagcatgatctcagctcagtgcaacctccaccacctgggctcaagcaattctcccacctcagcttccagagtagtgaggactacaggtgcacgcccccacaccaggctcatttttgtatttttttgtagagatggggtttcgtcaggttgctggagctggtcttgaactctgaggctcaagcgacccgcccaccttggcctcccagagtgctgggattacaggcatgagccactgtgcccagcttacaatatttttaggatatatttttttcctaattgtagaccaacaaaacaagcactttcaccaagtagtgtgatgttaggcgttaggtttttttcctaatttttaaacagcatcacagctcaggaataaggtcttcacctttgattttcacgatttttactacaatgttgtgattctcatggttattattcttgaagtttcatgatttttttattttatttttgagacggagtctcactctgttgcccaggctgcagtgcagtgccatgatctcggctcactgcaacctctgtctcctgagttcaagcgattctcctgcttcagcctcccgagtagctgggattacaggtgtctgccaccacgcttggataatttttgtatttttagtagagatagggtttcaccatgttggccagactggtctcaaacttctgacctcaggtgatccacccacctcggcctcccaaagtactgggattacaggcatgagccaccgtgctcggcctaaagtttcatacatttgtaaactgactgtttaaattcaaaaatccagtcattaagttcctcaatttttttccatctttttttttctttttcctcatgactaagaatcatattctcatgtttattcatatgtatggtaattttctattatatacagacaatgtatgcaatacattatagagactctgaatttagttagcttttcctaaagagtgttgatttttgttctagcaggcatactactactacctggttaccttcattttgtggagctagttttgtttttataaaagcatagtggagtctattttggttccctccttaatcctatggtgaatgccttcgtcctgggaaacattctttaactctttaagtgtgagcctttattggtttcaatcaaagccctcaggtttttgccaagtctagttggaattcgaactccaaattctgccttccctgcattaggcaatgatgatcttctctgctcagctctttcagccttccaattactgctttccactatgccctataaaatcttccctaaacatgtgcaggtcaggggtgagcacaaagatctgaaaggggctcaaatagattgtgggcctatgcccctccccatctcccatagctccctctttgccactattcccctccttcaatttctacctaacttggcagccctgaactccatcctctgataatatacaaacaagcccatgaagcagtgactattgaattctagaagctctggggcacatggactgagaatgctctcatctcttcctggcaatactttctgtctgaaattttgctgacattgttgagtaatttacctagtaatatgcacaggttccaagcttgcccttctttgctcattactttttcttaagcaggggaaagcaagcttctatttgaagagagagaatgagaaggtggggaagataagaggcatgtttcaatacactagagaacaactctcaaccgctttttacatgctctctttccaagggcacaccctctttgttcaaaaggagtcttaaatttcacagaagcatttatctgtacacacgacttatcggcagctaccaagctagaggcccgttaagttttctctccctcagctagccttacacctttaaaactgcctttgagtcagaagtcagaatgaagaggttaaaataaaaaaagaggcatttttctaggcattcctccttaggtcttccctttctctaacccactactctgtggtataaaaacagtacccacttccctaacccagaaaatattccttgatttgctccatgactcaaaaaaggttcacccatgaattcagtctccagttcttttgctcataggttgggtccttttagaacaacttagttcaataatatctgtactgtattcaagacccaagcagatatatactggttctgtcaataaacaatcatcctgtttggaaataaagcaaaaagactatgtatccttgcagtgtaccactgggacattacctaacaagcccacccaggaaacatctgactctccataaattatttaactttgttttacctactatctataattgattagggcccagaagtcttactggatgtttattttagaacgctgacaagttaaagttggtttgcatcttgttgaaaacaatgtccaaagttacagctttattgttctataggatattaataacttttgtatgctactgagtaatcatattcctgcattcttcctttttatctggtattaaaatactgttaacagtttggccaccatcatgattcccttgttattcagtaaatcactatatatttaggaattatgtctaggctggtgcagtggttcacacctgtaatcccagcagttttggaggccaaggccagcggattgcttgtgctgaggagtttgagaccagcctgggcaacttggtaaaaccccatctctacaaacaatacaaaaattagccagacatggtggcacatgcctgtagtcccagctacttgggaagctgaggtgggaggatcacttgaacctgagaggtagaggctgcagtgagccaaggtcgcaccactgcactccagcctgggtgacagaataagaccctgtctaaaaagatggaaagaaagagagaaaaagaagagagaggggagagagagacagagagagagagaaagaaaaagaaaagaattatatctaatgttttgaaactatattttgacaattctaaagacgctgatttttttgttaattccagctgagtttcagaaatgagaataaaaaaattaaacataacagaaaatacctctgacattattatttttaaactacaagtcttcaaatatatttttgggtaataaacaagcacagtccaggagtttgaggctgaagtgagctatgattgtgcgattacactccagcctgggtgacagagcaagagcctgtcttaaaaaaaaaaaaaaaaaaaaaaaaggaataaatacacctacctccatttggggaaaaaattaacaaaatggaaaacaggctggttacatgtgggtatgaaaacctacagttgccctctgtcccgggcaacctaatttttttttttaagcaaaactgagaaaagtcactttcctaaaatttaaaacaaaacaaaacaaaaaaacctggggaacaaacaagcaaagttaaatactgccttcttatacagaaaaactttgcctggcaattgacatacgcacagctttgcaaatatttggcattttaaaaatttaagtcaatagcttttaagaaacatatgctctgcgcccattctactaataataaacaatggaaatgtattgtccctgctccccccaccccaccccccaacccctgtcttctcttaatactttctgaacgcttttcagaaagcatggatatattcataaagggtagataattcacgaaaacagggaaggggtaatctctccttgacaaaatagtgacagtgtatacttagttgttttcattatttattttactcaatccaaaaagcattctattgcacaatgttgaaactagtatggccaacacaaagggaaagatggtcttgaccttcaagaatcttacaatttaatacacacacaggaatcttacaatttaacacacaagtaaatgaatgaagggtagggaaaggaccaagctcctaaagagtgtgtgtgtacaagtgaatctgtataaactgtctcacaatcactgtggattttttaagacaatgaggattagtaacacaatggaggactgttatgccctgtccttcagaagtgctgaggtaagagaaaacatgactacagggagattactcaaaaaagtttggaatccctaaattctatatacaaatatataagtatctacatagaacttactcccctatcacatatgcctcatgtttcatgtttcctgtacccataccaccaatgtatctatgtttcctttctcacttaacaatttttaccctgattagaccattcactaaaagtttcattaataacttaaaaaagatctgtaaacagcatgcaatgaacttatattatagacttaaatagtggcaaaacttggcattctgctctttaatttattcaaaactactttccagttaagaactatcaatcttctagtgtcttcacatttatctctagcaacagtggctggctttcaaaattaggtgagagatctttccaagatctaaacatctccaatatctgcctcagagaaaatttagtttccaccacatcatgcgttcctgctaacaatgattaaaataaataaaagaactataaggttggtttatttgcggatacaagaacagcttgcttaactcaccatttaaaaagccatcacttcacactagctttattatctgaagcataatcaaaataataaactacggttgtgggactttggaatttctaattaagttatggagacttaaatcaagaaatatgaatattcataaaacccagtaaccttttaggcaaagtaaaaaagtgaaaagaacaagtgctcttggaattcagaaagaaaattaactatggtattgagagaaaccaggaaagagaaggaatcacagtagagctaggatacagaaggaaacagaaaatgacagtttaatgctcattatagaataacagtgaatcacccacagagaccattttcagtgttcttgtgaatttaacctctagtctaaccttttaatgaaaaggctataatatattagagtggcccagaaaggtgaccttatgtctcaggtgtcagagccacacccaggtctcctgattcccaatgatactccctaaagccttacttgctctggctgtagtgttttgagaattggagctgcttttaatcctatggtcagctacacagctgcaggatgggccctagattccctattcaggaattcagatcttaaaacaccaaaagtgataaaagtagatacagttccccttcttcagccaatgcaaggatcctagttacagagaaaaaacggtgtgccaagacaacacccttaattctcacgcatttccccctttctatcttttatacttaccaatttatcagtcccatgatctgtcttcacctcagaactaagtggaagaaataagtctgttgtatgctctgggggaggtacctccccaagaactatcaacccctgcaggatagagaggagaaaaatagcataagtgagcagtataaacttcaaatttaatttaggagttaagtctcaaaaggactgttggtgtactagaggccccctcttcctcaccctatggttcagaaacaaactacagcagcagcagctttgttttcccaaagagctatttcaacaagcagcagacccaggctcccctctctgccacttgactgctctgacctacatggctcatcagccatttagcatctttattcatatctttcagatatgaaatctttaccagattatggcatttataccatattactagactccactagattaacagcagcaatgcagtttttgtagccaacaaatgcagtttatgacttactaagctgaaaatgctactattcttaatcatgtactccaccaactatacctgcacaaacaaaactgaatgaaacaaatgtggaacagtcccctacaatttatgagaaaccaagagcttcttaaaagctggcccaaaggaacctgcttttttcataagcataaatattacttcagattaagttcctgcttgacaatttcaaattcagacctttggaaattcattccaggaaacaatttacataaaaagaaattaaaaatgaacccacaagtcctccccattgtacatataatgagccaggatgggtaaaggcagaaggtatcttattattaaaaaaacaaaatactacatatgaatcccaccatgtataccagaagaggtgacaaaaataaggctatgacactatataaccgaaagactgggatgcaagtgatcagggttcccaatctctttctctggtctaaaaaatagagatctaactagattaagaagctcttaatggaaatttattatcagaatcacctggggaaccttatcaaactatactggcttaggtccaacatctactcagtacctctgggggtggggccaggtagtctacctttttatgggggaagggaggcaggacatggtgggtacatggaggtgggtgtctctctcctcccccaccccgccaaccccactatgttaccgaggctgatctcaaactcctgggctccagcaatcctcccacctcagcctctggagtagctgggatgacaggtgcctaccaccatgcccagaggtggatattctactattctttaaaagctcccctggtaagtcctaaacttgtaaagttgaaaaacactagacttgattagtttgggctcaaagaacatcctaaagtatagatttgggggactagggattgtgactattagtcttagctctctaggccatacgacagactcttatgagccactaaaccagatgatccatccctggggtccttgtaactaaaaaaccaatatgaaatacaagctgcagaaaaggggaaaacattaagaaagaaaaatggaattttatttcagtttttaaaaaagaagtatgtatctctttttctcttgaagcaaaagaagcactgcctccctattctggaatatgactacacttagcctgtatcaaaaatgaattggagggtcccggaatggcggctcacacctgtaatcccagcactttgggaagctgaggcgggtggatcacctgaggtcgtcaggagttcaagatcagcctggccaacatggtgaaaccccatctctactaaaaatacaaaaattgcccaggcgtcgtggcacatgcccatagtcccagctactcggaaggctgaagaaggagaatcgcttgaactcaggaggcagaggttgcaatgagccaagatcacaccattgcacaccagcctgggcgacagaccaaggctctatctccaacaacaacaacaacaacaacaaaaatgaattggaggctgggtgtggtagatcacacctgtaatcctagcacttggggaggttgaggttaggagtgcgagaccagcctggccgacacagtgaaacaacgtctccagtaaaaatacaaaaaatagctgggcgtggtggtgagcccctgtaatcccagctacttgggaggctgaggcaggagaatcgcttgaacctgggaggtgtaggttgcagtgagccaagactgtgccattgcactccagtctgggcaacgagagcgaaactccacctcaaaattttaaaaattaaaaaaaaaaaaaaaaaaaaaaaaaagaattggagtctcctcagaaacaagagaaaggccattaactagtaagcaagaaacattaaccctagcctttaaaatgaggtttctctggttaaagaacttctgcttcaaaatattttcttccctaaatcaaaagcataaaatataccttacaaactttatcacatccaaataaaaactatttgcaaaagacagttatcttgtacaccactgccttctcaaaacgttgtattcaacagatattccctacttaagggcccaaactgtcttcctgcttcctgtacaaagcatgccaaaaatcattttattattcaaattttcccataaccggttcctaagaacttttttaaagatcaatttccaactactttccccaaatatttgttagtgttataccaatctcatcatctcctagacaaatgtttcaatgaatgtgaagctgttgctgctgctggaggtaagggttattagtcagtagaaggttaaaaaaaactgaattaaaggttaacacatgagctgttcatctttatttatactcatttttatattttatcagtccaaattgccgttcgtccttccaaagagattttcaacaagtcccacctccttccaagaaaatgtcccgggttaatgagttcctacttgctttatccacactgccagacctcctaaagcacggtgattgtatcttactttctgtgtatttaaatctcatttccagagcattcataatcttatgccacattatttatttcacttattattgcctcagtttcttgtttgttgagacagggtcaagctctgtcacctgtgctggagtgcagtggtgtggtcacgaatcactgtaacctccccctcccgggctcaagtgatcctcccacctcaaccccataaatagctgggataacaggtgcatgccaccacatccagctaatttttgtatttttttggtagagatggggtttcaccaagttgctcaggctggtctcgaactcttggactcaagtaatgcacttgcctcaaactcccaaagtgctgggataacaggtgcaagccaccacacccagctaattgttctattttttggtagagatggactttcaccatgttgccaaggctcgtctcaaactcctagactcaagcaatccacctgcctcggcctctcaaagtgctgggattacatgtgcaagccgctgcacccagcctttaattgttaactaatgttagtttattgaagatgtggacaaaatacaaatatatttaaatgacccatgtcccttagcagagtcatacaccaagaaaataaatgcatagcaaatatttgttgagttgtataatttttttcctaacaggaaaatattaactttataataattatagccagaagataaataaatctaacaattagatataaaattactccttcaatttttctttttcagttatatgaaagtaaggacgcagtcagtattttccaaagggaagaatttttccttaaactacagaataatttctaaatacaaccctcagatagattatgaagacatctcctaagagagtataataaaacttggtagggaccatctattcatcgacataattttatagacccacagaggatgtaggtcaaagcttatgtctctacaggccaatacatggcagaactggggcaaaagtctgcatctaactaatatttcattcctcttttgttcagttaattcaatcatttatccgctcatcagcatttgttaggtactaaggatacaagaaaaaatgagagacctatccctctcccctaacccatccttcaaagtgcttattacgttctaatactgcggcaaagaaaaacaatgtaaataggtaaatgttatgtactacattagaaggtattaaatgctagagagaacaaaatataggatagtgaggggattaagaagtggaaatggtggggttggtcgtgacggctcatgcctgtaattccagcactttgggaagccaatggaggaggactgcttgaggccaggagttcaggaccagcctgggcgacgtggcaaaaccctgtctccacaaaaacaataataataaaaattagcctggtgtaatatcacacctgtagttccagatattcaggaggatcacttaagcccaggagagagagagagatacaagtgggagggggtactacaggcgcataccaccacgcctggctagttttttgtatttttagtagagaaggggtttcaccatgttgccaaggctggttgcaaactcttggggccaagagatctacccgccctggcctcccaaagtgccgggttgcaggcatgagccactgtgcccctgcttgaatgtttatttgaagacagaatcaaccagctatgccaatgtgcttacaagataggagggaaaagagtcagagacactgccaaggtttctagcttccacaaccagaagaatggaactcttcttcatttgttcagaggacatttgaatacacattagttttaattaaacctatttttgaaaatatgtgctcaagtgttacactgaagcaaccaacaatcatccatacactgtccattgcccccaagatatgtaagttcactatggcattcaaaaccaaacactggatcctctaatttaatactgtacctcacaccaaaaaggatgaaaacagctaaaaagaggctgagcaaataaaaagcatccaagtaggtaagagtcattcatgcaggtagcatctattgagtggctaccacgtgcaaggtagtgtgaaaacacagtaataaaataaaaacagattctaccataaggagcttatgttcatctagccttgaacagacaaagagacaaagtattatgacagtactataacagaagttgagagaaggtgatgtcagagcagaaaagagcctaactgaagagactgatgaaagtgaggctttacagaggaggtctacataattacttaacattccccaaaatatatttaatatattttgagctatacttattcattaactatacacttaatgactttgcccttttctgtatacaatgtttcatatgccacaataacacttatttcggataaagtttactcatgtttaataaccatgaaaagaaaggttagcattagctgagaaaacttcataatgttctactccacacctgtcatgctaccccaacatgggcttccctaacattccaggtttaaactgggtcagtgttgaatagctgtgccattagcctggtggcaataaacttagggctgctgtactatgaaatagcaaccggtagaagccgaagaaaaaggtcaagagtctccttttccttcgccatgtcccgagtcagagccaggatcatgcttaggctgcacaggcctagaaaactccaagagtgaagcaagcttctgctttacacaaggaccaaaggaactggaatgggtcacagttacatgcagccttaatacctcctaagtgactcctctgtggatgaaccctctctcaactgtatttgcaatacagctaacaggcaatttcacatacttccttacatcactctatcaggtcaatcttccctatgcatctcaagacaaaccagtgaccccactgcagaccagttccacaagaatcaccctgggctacctggaaaagataagttgtctaaagtgctttaaaaaaccctattaagatgagaacttcaacagctttatgaaaattttgaagagaaaggtgttataagcttctgcagttcccattcaactccttccctattcaaaagtttcaatgctcttccacctcccatcctcaataacatttccatcctcagctacagctgtgtaatctcaaagagtagtcagaagaggagattttaaaaaacaacgtaagagtcaagccagtgcttctgggaggccaaggcaaggaggatcacttgaggtcaagagtttgagaccagcctggacaacacagcgagaccccatcctttaaaataaaaaaaaccctttaacaattagctaagcatggtgggacttgcctatggtcccagctacttgtacttgcaaggctaaggtaggaggatagcttgagcccaggagtttcaggttacaaagaactatgatctggccattgcacctcagcctgggcaacagagcaagaccctgcctcttaaaaactgcttagtccctattctttcccctcatttaccaggtgtgaaatttcaacaaacatgtttcagtgaaatgatgaaaaggacacaacagcaaagtatgttagaaaaaaaatgctttggaatcagataaaaagtcctgagtttaaatttagctctgccttttacaagcctctgaagatttattctgatcattaaacgaacatacatgagtaaacctttaattagtatacactcaaggtacgtatattgttttcgtttctccttctaaagcatggaagagtttctttttaaaaaacaagctgacaaactatgaaaattaaaagagtacaacagcatgcagaagtagtacagaggagttcctagaagttatattctttctccagagagcaatattattcccaaaagggactctactcacttcacagcttggaaggtaatacctaccttctgacagaacagaaactggtgtctggatcctagaatcacctagcagtagtcacaaatactttttttttttttggtaatacgccacttaaataaaattaatgttaataagcaacaaagtaaatccttaaaaagaaaagccccaccatccctccaatctcccacccgaagacaaattataactcaacagcctatcaccaagattcagcctatcacctaggttcatctcaaaaaaaaaaaaaagacctgtgcaacccaggaagtgctgggaaatcttggtgcagcatggaaaatatgaacaccaacccacttaaccaaaacacataggaaaaactttcttccatttcagtaactaaaaaaaaaacccaagcacttaaagtgattactaacttgagcaatagctctgcactcacttggatgtgtaaccatgaacaaactacttgactgctctgatcttccattgtttatcttgaaaatcgtgaatgagagtaaaatgcttagcacagtgcctgacatatcacaagtgctcaaaaacttctattaattatagtgttacataaagactaaatgcatgtgaatatatcattgggggaaaattccatggcttgttagagcaagttgaatattgtctcttccaaatttatgttcacccagaacctgtgactatgaccttgtttagaaaaagggtctttgcagatgtaatcaagttatgaagagccatttagtgtgggctctaaattcaatatgactggtgtcctcctgacatggaaatctacacagatgcaaagagaaagatggtcatatgaagatggaggcagcaactgcagtgatgtagctacaggccaagaacaccaaggactagcacaatatcagaagctggaaaaagacaaggaaggattcttccctagagcctccatagagaccatggcccttttgacaccataatttcagacttctggcctccagaacggtgagagaacacatttctgattttttaagccatcccatttgtgatagtttgttatgacagtctaggaaactaatccatttgttgaaaaagaaatgtataaatacgacacgtaaagctgtgaattttcttgatgcattacttattggaactatcaacctagttttattcttcctatcggaactctgagaagtaaaagattatctatgatgttgtattttacagaccaagaatctgaagctcagaaatgttaagtgacttttcttctcaaggttcatgtaagcagctggtagcaaagccacgattagaaacaaaaatttaccaagtccaagtatggtgcttaatacaatacgctttgaatgatgaaactcttggataagcaacatacattcatgtgccaaatagcattatggtcaatgacagaccacatatacaatgatggtcttataagattttaatacagctgaagaatacctgttttagcacaaagcactactcctgtgtttgtggtgatgctggtgtaaagaaacctacagtgctgctattagaagtataccacatacaattatgtacactaagaatataatagctgataataaaagctatgttactgttacacttatttcttatgataataaaaagtgttatgtatttactatactatacttttaatcgttattttagagagtacttctactcattaaaagaagtgaactgtgaaacagcctccagcaggtccttctgttggcactgtcacaggcaatgaaagctccgtgtgtgttgttggccctgaaaacctaacagtgtaacaagatgtgaaggtggaagacagtaataccgacaaacctgaccccatgtgggcctacgttcatgtgtgtgtttgtgtcttagtttttagcaaaacagtttaaaaaataaaactttcattttaaaatggaaagttttaaagatagaaaaaagcttgtagaataaggtgtgaagaaaatatttttgtacaattacaatgtatttgtgttttaggctaagtgttattacaaaagagtcaaaaagttttaaaaacttaaaagtttataaagcaaaaagttatagtaagctaaggttaatttattattgaaaaaaatatttaaaataaatgtagtgtagcctcggtgtacagtatttataaagtttatagtagtgtacagtcatgtcccaggcttttcaatttcagttacccttcacccaccgactcacccagagcaacttccagtcctgcaagctccattcatggtaagtgccctatacaggtgtaccatttttatcttttctactacatttttactgtattttttctatgtttaggtatgtttaaatacataaatctttaccactaattgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatatgagacagagactcgctctgctttgcccaggctggagtgcagtgtcgcgatctcagctcactgcaccctgtctcccaggttcaagtgattctcctgtctcagcctcccgagtagctgggattacaggcacccgccaccacacctggctaatttttttgtatttttcatagagacaggggtttcaccatgttggccaggctagtctcgaactcctcacctcaggtgacccacccaccttggactcccatgcctcggcctcccaaagtgctgagattacaggcgtgagccactgcgcacggccctcagcttgaatttaagtgcactttatgatgttcacgcaccaatgaaatcacctaacaacacatttctcagtttcccttttgttaagcaatgtgtgatggtatatacaaaactccagattattttccagatatttagaaatacttttcagatattttgatattttgaaagtttctgaaaattgctctgtcattacttctgagtgatgagctgaagaataaagcatgaaccaaatgaggtgagtatcttcttatacacagctagtgagactataaactgacactgccaaaatacttctctgaagaatgcattaagaacataaaagagcattcatacctttgactgagataaagatatttatcatggcatatttaatttaaataacaaatgtaacttaaatagtcaacaaagaaagccaatagcatgcagccattaaaaatgttttccaaaaaccaactgggaaatattcagggcacatacgtaacatgactgtatttgaacaaattacttatgtgctaggaaaatgtaccataatgttggtagcgagataattttgagctgttgggttgttttttttttttttggggggggggggagggtgggtgtcttttatacttctatgtcatttcagtttcctgagaattgatacacagtatttcatcaattctaagaggtactctccccacatgtcaacaacttttaaatcaagatgcattttacaatttctgttatgccctggtttaactgaaataatttctttgtcgtacttaaaacaatggtacatcttacaatcaatagcatcttaagttctatgaaatgtagcagttttataacaaggaactaagatgatataacatatacacatatataaacccacatatatatttatgaatgtatataaaaagatgaagcagcacttatgactactattatactaatctcagttgttactaagagactctagttctcaaatatagaaaatcccacttaactactggctataaaaacctagaaacagacactgaagaggtgtctctgatagagaaagactgtgtttttctcctcagtacaggcatatccagtcacctcctagttattcttagtcatcattccagttcaagttctacaaatctcactttaaaatttcctttgtgaagacttgggaaagcaaaatatgcaccaaatctagaatgtttattagttttgttccagctaatttttaaataagtaaatcaggatttaatttgtatgctaccctaagggaacaaactagtaagaataaaaaagtgagccctctggactgtgtcctcaattaaagtatgctctattgaacttttagggggagggggaatatatatatatatatgtatctccaatctggaaagaagctataagtccgcagtgacatttttagaataaaagtttaaatgattagatagcccacagaactttcacttcaaaccctgatcattctgttcattttatcagttgatcaaccttcaacttttggcctactaatttaatggatactgttcacaggaaagccattttcttaaggctttgactagtactaaggtcaaaaaggcattttgacccttatttttagtagcaatagactttttctagacatgggtctacataaagatagagctcagccacaccaagctaatataaaaaatactttgcaagaatgtaagcttcatgaaggtaggatttttgagaacactgctgagacacagtaagcacttaaaataatggtacatcttaccatcagtagcatcttaagttctatgaaatgtggcagttttataacagggaactaacaaatataaatctaacaaatatgacagttaacatcaatggcttgcttgcattattcagtctgttttccttgtttcctgttagctcagatacccacacagttttgttctaaatacacgttcagttaaacattatattctaatagtgttttcctttttatgagacaggcctttcttagttgtccaggctggagtgtggtggcacaatcttggctcactgcaacctccacttcgtgggctcaagcgatactcccacttcagcctcctaagtagctgggactacaggcacatgctatcatgctcaactaatttttgtaatttttgtaaagacaaggtctcactatgttgcccaggctggtctcgaactcctgagctcaaatgatcctcctgccttggcctcccaaagtgctgggatcacaagagtgagccaccacgcgcagccacatcaggttcttaaattaaaccactatatcaggtcattaaaccatttactttgcaatagttaagaagagggttatgggggttacgaggtgggaggggatgtgagaaaagcgatattgatagttttcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaagacaggtggtaaacgattcttcactccaactagaaaggaaaaaatgacaacatactatgaaaaaagctatgaggcaggaaaaagcacacgtcaaggcatggagatacggatatagactaggtaattttgcaaccacataagtgaaagaaaatttgctatccaatcttcctattctctactcccaagagcctagtgcttttgtatagttttcagctcagtaaagtgcctccagatttataaaagctcaatgacaataacaaggtatctttattacaaaatagttgttaaaagtttgattcgaaaaattttaaggaaacctttcaggtaactgaaagtggagggtaggggcgcgactcatgaaggagttttttaaccaaagaaatgatatgatacatttttaaatgaccacttcagttgcaatataaaataacagattttggaggaaaatgtcaatacaaggatatcaattatcaattattaggttactatattggttcaaggagagatgatggtggctgtggagatgagtgaaatcaacagatccaagatatattttagagagtattgtagaagactaggaatgggagtgaccagacaggaatgaagacttctagacttactgcacactgtcatgaggaaggatggggatggaagggtacagtggaataagctgggttttagcagaaggaatcaagagccccattacaaacacattaaatggcctggcgtggtggctcacgcctgtactcccagcactttgggaggctgaggcaggcggatcacctgaggtcaggagtttgagaccagcctgaccaacattgagaaaccttgtctctactaaaaatacaaaactagctgagcgtggtggcaggtgcctgtaatcccagctactggggaggctgaggtgggagaatcgcttggaccctggaggtggaagttgcagtgagctgaggtcgcgccactgcactacagcctgggcaacaagaacaaaactccatctcaaaaaataaaaaataaataaaaataaacacattaaacgtttataatgtatttacaagactaacaatcagataaagtctgaacttcagaaaggagatagagctgacctgaaaatataaattacgaactattgttatatgaatgttacttaaaagacgaggaggccaggtgtggtggctcatgcctgtaatcccagcactttgggaggccgaggcaggtggatcacttgaggtcaggagttcaagaccagcctggccaacatggcgaaaccccacctctaccaaaaaaaaaatacaaaaattaatcgagcacggtggcatgcacctgtcagcccagctactcaggaggctgaggcaggagaatcacttcaatctggaaggcggaagctgcagtgagctaaggtggtgccactgcactccagcctgggcaacagagtgagactcggtctccaaaaaaaaaagggcagaagatggggcggaagaatagagataggaaagaggaggatgttgagaactaaaccctgaggtacttttagtattcaaagtgtaggggggtctggaaatcttgtagagaccagtaggggttggagtatgacatcttccaataatgaattctcgttgctgtccccttatgggtctgggtctacctgatagtctcttctggaagtcggtatcacttgtgcttaatttctactcttttgtgccctctatacagcctctactacaaatcttttttgaagaagcacagggagaaataacttggggaaaaaaaaaagcctatcttttagaaatagattctgaaatatttacagatgaaataatatgttgtacagaattggcttcaaaatagtccaagtaaggggtggtctagataaaaaaaaaaagaacagctctgagtagatgcctgttacagttgggcaatgcacacatgggaaggttcactgcactggtctctctgaatatttcacaataaaacataaaacatagtatggaaggttggcaaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcgtagcccgggcggattcagccccacaaaatgggcgcagtttgcaaacagccccccggcctgggcgccgagggccagcggcgggcgggggcgcgcgacggcggctccggcccgggcccgccgctctcctccccccgacgcccggagccgccctgactttccgggcgggggggcgaggcagagggggaggggaaggcggcggcggggagcggctgctttttcttctctttcgggccctttcccggccttgctccgcaccgacggggcccgagcacggctggagaccgcagcccggccgggagggcgggcgggcgggggcagagagtgaaaccgcccccccgccccgcacaaacaagcaccgccgtctgcagcccgaacccgcacccaggccgccacccccggccgcctctttccagccggggagcgcgcttcagccgccccccgcgccgccgcggcgagacgagtcggcttcgctacggtgctcggttctcccgccggctcggcgagcggtggcggcggtggcggcggcactgggaaaatggcggccgagctccttttccctccccccctttaatctgaagcggagggagaatggagcgagcgagcaagcgggcgagcgccggggacacggggaggagggacagcagcgcctccgccggctgcggctgcggcggcgaagggccgctccaccccggcgcgccgccagggggcgcccgccgcgccgcccccgcgggccgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggtgagtctaacctgaggcactgacgccgtcacatgccctccgtgctggggccggcggtgcggctcgccagttgaggggcagggcgggccggcgccgcggagcgagaggacgtgagcgaggaactgtttgcactgtgtagtaaagagggtaaggccgtcggcaccacactattccaaggctaaccctgcagaaagctccctgaccagtgaagcggcttccgccgcccgccctttgtccctagcagccagcctccgtatactgcagcacggctgggcactagccccagcaccgcgctccgcagccaccagagttgggcggggtggggagggtgcacgtagtcactgcgcaggccccagccagggcccgcgccgggccagcccgggaagggacagccgggagccagaggggaagtgatggccccgccggcgccgggcccgctgggaactgtagttttcgtgaagaaacacgcgtcttgttttgggtgtcatggcttggcagatccgccaaaacaggcaaatggcattacacaatgagtatttatgcttcctgccgccaccaaaaggaagttcactgccatgctaaaagtttaacaaagaactccataaagaaacacaagtctcacaacaaaaagccaacttcccacctcgttaccagagttggtttaaagtggtggcaccttatcatttctcatgaccagtttatcagtacagaactttatattgtccccaaaataggacctttaaaataatggaacctttcctagacttaaagaattcataaacataatgtaatacaaagtgtcacacaaagtgtaattctaccaccctttaaagttgccaaaagatgagtggagtatcttgagatttaaaagactaatctaggattcatcaaaactggcttaaatgactgaagaaaaaatcgttcaaatcattaaatcatcaaattcggcagataagaagggtatgtatgctctactaccaaaaaggaagacgcaaaatgcttcacacttttttgtggcttaccagaaccaatatccggcattatacgtcacttctgcttatcaaaaaacaccctcacagtcgttacagaacggttttagtcttcccacaaagttacactaactcacctgcccctgcaacatctgcacctaggtttctgcgaatttccatttgtactcctaaaatcacactctcaagcatagtcatagttctcaaataccaaaggcaggcagtttggagtcatagggtcaaattacacaaagaataaactaatatttgtatacacatccaaaagaggtctttagtcttggatttttaatttacaaccctggggaaaaactttgacttttttattgtacacacatacacacataaatagtaattccacaaaatacagtagaagggtattggaccaacagatggcgaactagagccccaatctgaggctcctgaaatctaaattagcagaatgaaaaataccaaataaggcaaagccctttgcagcgtatacttaaatattaaattcagacacaccataacaaaataatcttactgctgctccaaatttttaagactgaactgtcagatttaattaggcaaccaaataagcaagattatatgaaatatatttttctaatggattaggagaaaactggaaaatgctcatttttaaaaccatgtatttgggggaactataaattccagtttcccctttctctcattgcttagtgcaagagtcaagagttcacagggtttatggcacttaaatcagtcaacctgttgtatattcttatctaaaatcagacatctttcttattaggcatccacttgtacttttatttttttgacagggtcctgctcggttgcccaggctagagtgcagtggtgcaatcaaactcactgcagcctcccaggctcaggcgatcctacctcagcctcttgagtagctggcactacaggcatatgccaccatgcccagctgttatttttttcactcctttttgttttggtagatacagagtctccctatgttgcccaggctggtctcgaactcctggactcgagtgctggcattacaggcatgagccaccacacaaaaatcttatgaagagaaacaaattttcttaaatttccccccaaaaaatagtggatgtccaaaaggctgattgaaaacacctacatacaaaataaaacaaacaaacaaaaaaagatttaaagaaaaaggcctggtgcagcagctcactcctgtaatcccagcactttgggagggtgaggtgggaggatcacttgagctccggagttagagaccagcctgggcaacagagtgagaccctatctctacaaacaaaattttaaattagccaagtgtggtagcatgtgcttacagtcccagctactccagaagctgaggggattgcttgagcctgggaggtcaaggctgcagtgagtcatgatcatgccattgtagtccaacctgggcaacagagcgagaccatctcaaaatgaaaagtgataaaaaaataaaaacaccaacatatttcaaatcactcttggaatagtcatgttgactctccaatatccactctattctgattagttttaacccattctctttgccaatgattggttaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagcctgaagatgccaccaacatcaaagggaatagagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaatgattgagttctaatgttttttagtatttgtatcttactttatgattacagtattttatataactaatcttattatttcttcctcagaaaagacattccatggccaggcatggtggctcacacctataatcccagcactttgagaggccaatgtgagagtattgcttgagcccaggagtttgagaacagcccagggaaaacagcaaaacttcatctcttcaaaaaataaataataaaaaaatttagccgggggtggtggcatacacctgtagtccaagctactcagaggctcaggcaggaggatcacttgagcccaggaggtcaaggctgcagtgaaccatgatcacgccactgcaaaccagcctgggcaacagagcaacaccccgtctccaaaaaaagaaaaagaaaggaagggaggaaggaaagaaagaaaaaaggaaaaggtgttccctcttacacacagctctgtatccatccatctttgtctgtgttctctctacctagaaaaagaggaccatccctcattaccaccattccttgttaattcctctctccaatccacctacaactcatgttatcctcttatattccaccacaccactgttatcgtctactcacttcacttgacaataatgtaggctgggcgtggtggctcatgcctgtaatcccagcactctggaaggccaaggcaggcagatcacctgaggccaggaattcgagaccagcctggccaacatggtgaaaccccgcctctactaaaaatacaaaaagtagccaagcatggtggtgcacgcctgtagttccagctactcgggaggctgaggcatgagaatcacttgagcccggaaggcagaggttgcagtgagccaagatcacaccactgcactccagcctacgcgacagaaggagactgtgtctcaaaaaaagaaccaataatgtacagagttggcactacattacccttggttaaatgctgtctgtaattcctctgagtttgttttcatataccagtcttgccacctcaagccagcctgaaagcccttgcaggcaggaactgtggttgttctaatttaagatctgtaactcatctatagataataaacgtattccaaaaaggcactctctaccttccctgccacagaccttctaaacaagccagaaattcctaaacagaataatctcacaaattcagtacctcgtatgtccaaactaatctcaaaaggacaatgaataactttttttgcacttaagaaaaagcaattattatatattaactcaggacaagttctaaagcctaggccatttagtttcaaaagcacaggggcccatttttttggttacttacctaggacctagcccagggcctggcacaaaagagacacatcataagaactgactgaataaatgaaaaaggtagagtgtagtacttaagcacacaggacctaggtagcccgattctaatcctgcctccctcacttattctttgtgttactttgggcaaagtacgtattctgctctgtaaaatggagatagtaataccacctacctcttaagtttaactattattattagtgaatgaagctattttccacagttctaaactttaaaggttaaaatctgagtgaagcaaaaatcagcacctctttcctaattcaaacttcaaacacctatctacttaggacttggacctactttaattaaaaaaaaaaaaaaaaaaaaaaaaaaagcctggatgtggtgactcacacctgtaattctagcactttgggagaccgaagcaagtggatcacctgaggcctggagtctgagaccagcctgggcaacatggtgaaaccctgtctcaactaaaaatacaaaaattagcctggcattgtggcacatgcctatagtcctagctacttgggaggctgaggcaggagaatcgcttgaacccacaaggtggaggatgcagtgagccaagatcgcaccactgcactccaacctgagtgacagagcgggactctgtttcaaaaacaaaatccctgtctagactctagcaaacaatgttttcattcatgaacttagataacactatatataaaaatacttttagctccctaaaaacatattctgagaatgattatttacaatcataaatctaatgccacattaaatacttcaaatacatttaattcaacaaaaatctagtgagtacctattaagctcaagaatttattctagatatcacagaaatgaacacataaacctatgtaaaaacccatattaaaattataaaagaaacatctttaagctgaaactgaggcatgttctcacattaatatttaaccagctaaatattaaatagccagagtcaactaaaccaaagttaagaaatttaagtcaaaaaatttaggatgtagaaggaatatgttcagccgccacattttattagtgtgaaaatgaggccaacagaaagaagccagttaagagattgccaaagcgtcaaagctggaatcagggtctctcagtcttcaattctcacttttcccacttctaattcaccagtgctactcaattggtgaactggatgtgcaaacatgctaaaggcattaaacctaaaccatactacctatttcacagtgtcacaagtataaagatttagccaaatgcaagtagaagaaaatcctcatactgattacaatgactacaaagctcagaaatcaagattttttttcattaaatggaggccttagctgattcaaaatatcatacagtatttttatgtactgactgaatccagtagaaacaaactttcagtaagattaaacaaaagcatttcataaatggcaaagtattacaagaatgcatagcattccttcatttcaatccaacctaacaagatattttcctcctcatactactgatacaaactgcaggatttacataaagatattattttgccatctcaccacagaactgacccaataattcatacaaaagaaaaactaattattaggcagcctcctaatttaactgtgttagtaatgagaacaatactgttgtaggttaaacctaaatgtactagtaagtctagaaataatttactttaggataattcagaagacaacattaaagctcagctgaatacaattatatcactgaaagaaacaagtcaggttctctcaggccatcagctattgttaaaatctaacacccaagattgttggtcttctccacagtggtggatttaatagcagctaccagcactcatttctagtgcaagcagtttaagcaggattttatacgaacattttaataaagttcctcaatgagtttacacacacacacacacacacacacacaccctgattattttggtgaattttagttaattctaatgtttttaactttagaatattttaaaattctcaaataactagaatgtgtgaacgttcaatgaccaaacatagaaggagtattctaatatactgattttgcagattaagcaatctacgcaggacccaaactttttatcagataataaagctgagtgtcagaatttggccaaaatgtaccaagaaactacctgagttcttttccaaaggaaacataaaggtaaatatgcagaacttcaaggcagctgtgagcagccaagttgtggagggcctgacaaaagtgagtcagaagggaaaatgttcaaagagaaaaggaggcagcaggtgtacaaggcaaaacacaccttaaaaaatatctttacaggctgggtgcggtagctcatgcctgtaatcccagcactttgggaggccaaggtgggcagatcacgagatccggagatcgagaccatcctggccaacgtggtgaaactccgtctctactaaaaatacaaaaaattagctgggcatggtggggggcacccgtagtcccagctactcgggaggctgaggcagcagaatggcatgaacctgggaggcggagcttgcagcgagcggagatcacgccagtgcactccagcctgggcgacagagcgaaactctgtctcaaaatatatatatatatatatttttctttttacgtcagttgctgattctaagttatgatgcaacttgtaaaatcttgttctgatggcatggcaaacctagggactttggaagatggcagacctgtttcctccaatgaagcagcataccattcttggaaagggaattactttttttttttttgagacacagtctcactctgctgcccaggctgccaggctggagtgcatggcaaaatctgggctcaccgcaacctccacctcctgggttcaagcgattctcctacctcagctgcccaagtaggtgggactacaggcgcgtaccaccatgcccggctaatctttgtatttttagtagagacggagtttcgccatgttggtcaggctggtctcaaaatcctgacctcaggtgatccgcccatctcagcctcccaaagtactgggattacaggcgtgagccaccacgcccagcctagaacattatttttaacccactaattcttggattcttgaacttgtttctatgtacactcaggaacatacagctacaaacggggagtaaccaaagccactgaatatatgcaggagcaacttttttggagtatcaatttaatcaaggattatagtaaaatcagatatacttttgttaaaataaacacaaatatattacaggttgaccatccctaatctgaaaattcaaaaccctccaaaatctgaaactttttgagtgccaacatgacacctcaaatggaaaattccacacgtgacacctttgcttctgatggttctctgaaccatcagaaacactgtttatttcaagaacaaaattattttaaattttgtataaaactggtcggttgtggtagctcatgcctgtaatcctaacactttgggagaccaagatgggaggatcatttgagccctggagttcaaaaccagcctgggcaacatagtgagaccctatctctgaaaaaaaaaaaaaaattaagtccaggtacagtggctcaggcctgtaatcccaacactggaaagccatggcaggtgaatcacttgagctctggagttcaagaccggcctgggcaatgtagcaaaacctatctctaccaaaaacacaaaaaattagccaggcatggtggcatgcacctgtagtcccagctacacaggaagccaaggtgggagaatcacttgagcctggaaggtggaggctacagtgagcagagatggcgctactgcactccaacctgagtaacagaatcagaccccatctcaaacaaacaaaaaaattagctgggcttggcaccgtgcatctgtaccagttagtaccagctacctgggaggctgaggcaggagaatgacttgagcccaggagttctaggctgctgtgagctaggatcacattactgcactccagcctgggcaacagtatgagacatcatctcttaaagaaaaaggtaaaaaaaagaaattatcttcaggctatgtgcataatgtgtacatgaaacatagaatttcatgtttagatttggatcccatctccaagatagtacattatgtacatgcaaacatcccaaaatctgaaaaatctgaaatccaaaaaacttctggtcccaagcatttcggataagggatattcaatgtatacagagcaaaaggcagaattctcactgtttcaagatagaaaaggagtcctcagagagatatgtcctgcttgtaacaaacagctccaaacagccctagaccctgaaaagtactttaaggaaagataaagaggtactggtttagaccatttatagataaatatgcatggctaaaacccctgaatgtaatccttccaggcagaagataaaacctgaaatctaacgtataaattgtcatgggtacaatattataaaagagaccataagttaccgagaacatgactggaattcaggaaatgctaaaggtcctgtcttatctctgtaactcatttacaaagaaatcatgtatgattttctcaactgcaatcttttttgtttctgaattagactgacaaaaattatagaatataatattcaatattttccaccatattccaaattctcactatcacatttaaacacaattttatctaatgaaatgtgtcccaaatgaaccaactttaaccagcatcagaaaaaataaaataaaatagttaaatgaaactgtatcttctttggtataagaagtccttcaggccagacgtggtggctcacatctctaatactagcactttgggaggccgaggccagtggtttgctagaactcaggagttcgagaccagcctgggcaacatggtgaaaacccgtctctactaaaatacaaaaaattagccaggcgtggtggcatgcgcctgtagtcccagctactcgggaggctgaagcaggagaattgcttgaacccagcgggaggtagaggttgcagtgtcagtgagctgagatcgcgccactgcactccagcctgaacgacagagcagactccgtctcaaaaaaaaagaaagaaatccttcagcacagagggtaggaaaaaacaactactcacacttcccagaatacctaccgtggcaataccaaaatatgaccatgcttgttaatatttgggctacggcattaaatgtttataacataacacaaacacttgtaatccaaatgtgaatgattatcttcaattttcagtaaaataagaccctataaaagccctaccattaatacatattcattcataaacatactgagtaccagtggatgttaaacactgtagaatctctaaggaaagaatactcggtcactttataagctatgtggtagtcaagaaaaatcctttctactcattgatacgttaaatgatcaaaaaatccaaagctaaaaaatgatcagagaacaatgaaaaaattttagtggctttatgcttccaattccattttcttctggactcttttctgaagcttgcctaaatcatcccaggaatgctaaaattgggtgttatttatggcataaccaaaatgaaataacaaagtaagtaccccaaataaaactaggagaaaaaatccagggaaccaagcaggcagtaaggatctaaagttctatacttggaacctctaccctgaatgttaaataatagatgttttttaaatagttgactaccaagtgtggtggcatgtgcctgtaatcctagctacttgggaggctgaggtggagagactacttgagcctaggagttctagactagtctggacaaatagcaagaccctgtctcacgggtaggggagcaggggaaggcaaccaagctgggtgtgccatgtgcctctagtcccagctacttgggaggctgagacaggaggagtgcttgaaaccataggccactgtactccagcctaggcaacataggaagaccctatctctaaaacaaacataaacaaaaaggccgggtgtggtggctcacacctgtaatcccagcacttgaggaggctgagttgggaggatcacttgaggtcaggagttcgagaccagcctggccaacatgataaaatttttgtatctttagtctctactaaaaacaaaaattagctgagtgtggtggcaggggcctgtaatcctagctacttgggaggctgaggcataagaatcatttgaacctgggaagtggaggttgcagtgagcggagatcacaccactgcactccagcctgggtaacagagcaagactctatctcaaaaaaacaaacagttatatctttaattattatcttcattcagtaattaggcaattagaatttacaattgctaaatgaatgttcaaagttcaaccaaaattagtccaagatgaagccaagaacacatctcaactcattcaataaagccattattactctgatgccaaaaccagacatagatatcacaagacaactacagaccaatatatcttatgaatacagatgtaaaagtcctcaacaaagcaaaatgaatccagcaacatattaaaaggcttatacaccattgctaagtatgacttaatcccagggattcaaggttggcttaacttctgaaaatcaattaatgtaatacaccatattaataaaggatacaaaccacatgatcatttgaatagatgcagaaaaagcacttaacaaaatccaacatgctttcatgataaaaacactcaacaaagtagaaattgaagaaaacatcttcaatctaataaaaaatacctatgggggaaaaaaagaatacctacaaaaaccccatagctaaaatcatacttaatggagaaagcctgaatgctttctccctcaggtcaagaacaaaacaaggatatccactcttaccactctgtttaacactgcactgaaggttatggccagggcaaataggcaagaaaaagaaataaaaatcactcaggcttaaaaaaaagaaggaaaactacctttatttgcagatgatataatcttgtatatagaaaatcctaagaaaatcccacaaataaactattagagccaataaacacatccaacacagttacaggatacaagctcaatatacaagtagtaatcgtatttctatacacaagcaataagcaatctgaacatgaaaagtttttaaaaattccacttacaatagcatccccccgccaaaaaaaaaagacttagaaagccaagcacgatggctcacacctgtaatcccagcactttgggaggccgaggcaggcggatcacttgaggtcaggagttcaagactagcctagccaacgtggtgaaaccccgtctctactaaaatataaaaattagttgggtgtggtggcaggtgcctgtaatcccagctactcaggaggctgaggcagtggaatcacttgaacccaggaggcggaggttgcaatgagccgagatcacaccactgtactttagcctaggtgacagaatgagacactgtctcaaaaaaaaaaaaaaaaaagacttagaaataaatttaacaaaagcagtgacaatcttatactctgagatatataaaaattacaaaagaagttacagaaatcctaactaaatggaaaggccaggtgtgatggctcacacctgtaatcccagcactttggtagactgaagtgggtgggctgcttgagcgcagaagttcaggatcagactaggcaacatggcaagaactcatctctacaaaaatacaaaaatgagctagatgtggtggcatgcacctgtaatcctagctgcttggggggctgaggagggaagatcacttgagcctagtaggttacagctgcagtgagccatgattgcattactgtacttcactgcagcctggatgacagaacaagactgtgtcccccaaaaaaaaaaaaaaaaaaaaaaggaaagatatcccatgttcatggatgagaatggatcagaagatacaactctgttaaaatggcaatattccctaaattgatctacagaatcaatgtgatcccagcatacccaaaagaaatttgaataggaaaaacaaagttgggggactcacacttcctgatttgaaaacataattcaaagctatggaaatcaagacagtgtggtagtggcataaggataaacatacagatcaatggaatataagtgtgggttcagaaataaacctttacactgacagtcaattgattttatgacaaaaatgccaagacaattcagtggaggaaagaatggtctttttaagccaagtgctgtagctgacacctataatcccagcatttggggaggctgagacaggaggattgcttgaggccaggagtttgagactagccagggcaacaaagcaagacccccatctctacaagaaacaaacaatggtcttttcaacaaaccatgctgggacaactgaatattcacatgcagtagaatgaagctggaccactatatctcacaccatacacaaaaattaattctaattaaatttaaacacggattatagacctaaatgtaacagctaaaacaataaaattcctagaagaaaacaaagctaatcttcatttcatttggtggcctgacatcaaaaccacatgcaacaaaggaaaaaacaagtaaatttggcttcatcagaattataacattttgtacattaaaggacaccatcaagaaattgaaaacacaacccatagatgggagaaaatatttgcaaatcatgtatctcacaagggatttgtatctagtatatttaaagaactcttacaactcaacaataaaaagagaatccaattttaaaatgggcaaaggctgagcatggtggctcacaccagaaggagaggatcccttgaggcaaggattctgagacctgccagagcaatatagcaagaccctgtctctacaaaataaattaataataataaaaaaaaacaattagccaggcatggtggcacacacctgtagtcctagctactcaggagcttgaggcagaaggaacccttgagtccaggagtttgaagttccagaaactatgattgggccgggtgcggtggctcacgcctgtaatcctagcactttgggagtccaaggcgggtggatcatgaggtcaggagttcaagaccaacctggccaagatggtgaaaccccatctctactaaaaatacaaaaattagctgggcgtggtggtgggtgcctctaatcccagctacttgggaggctgaggcagagaatcacttgaacccaggaggcagagattgcagtgagccaagatagtgccactgaactccagcctgggtgacagagcaagactccatctccaaaaaaaaaaaaaaagaaaagaaaactgcgattggccactgcactctagccagagtgacagagcaagacctagcctaaaaaacaatagtgtataaaaataaaattaaaatgtgcagagaatttaaatagacatttctccaaagaagatatatgaatggccaataagcacatgaaaagatctcatcaggttgagcacaggggatcaggcctgtaatcccaacactttgggaggccaaggtgcggggactgcttgagctcaggagtttgagaccagcctgggcaacatggtaaaaccccatctctacaaaaaatacaaaaaggccaggtacagtggctcatgcctttaatcccagcactttgggaggctgaggcgggtggatcacctgatgtcaagagtttgagaccagcctggccaacatggtgaaaccccgtctctactaaaaagacaaaaattagccaggtgtgatggtaggcgcctgtaataccagctactggggaagctgaggcaggagaatcacttgaacctaggaggcggaggttacagtgagccaagatcacaccactgcactccaacctgggtgaaaggcaaaaatccgtctcaaaaaaaaaaaaagtttcaaagataaaacaaaaatcttgttaaagataaatacacgagatgctaaagaaataatctacttcttcaagtcatgctatcaatttgcaccaaaattttcatttcctatgtgtaggtgttgagggtcttgtacccatgataaatgacatacacctgttctgggctgacttttgttccccaaaagagatatatagtactccaaggggctgggcacagtggcacatgcctgtaatcccagcactttggaaggtcaaggccacagcatcgcttgagctcaggaattcaatatcagcctgggcaacatggcaagaccccggctctactaaaaatataaaaaaatagccaggtgtggcagtgcacacctgtagtcccagctacccgggaagctgagatgggaggattgcttgagcctggggtttagggggctggaggttgcagtgatccaagtgccactgcactctagcctggatgacagagggagaccctgtctcaaaaaaaaaaaaaaaaaaaaagatatgtagtactcctaacattcagcacctcagaacctgatcttagagacaggatcttcaggccaggtggcttcccttcctctccgcgtcagtctgtcccacctcagctcagcccaccggagacagagggtgcaggaacctggaggcggaggttgcaggaagccgagatcctgcaactgcactccagcctgggcgacacagcaagactccgtctcaaaaaaaaaaaaaaaaccttacaacaaaatgatgcagcccgggcgcagtggctcacgcctgtaatcccagcactttgggaggccgagtggggcggatcatttgaggtcaggagttcgagaccagcctggccaacatggtgaaatcctatctcaactaaaaaaaaaccaaaaactacagaaattagccaggcgtgatggcgcatgcctgcagtctcagctgcttgggaggctgaggcaggagaattgcttgaacccgggagtcggaggttgcagtgagccaagattgcgccgattgcactccagcctgagtgacaagagcaaaactccatctcaaaaaaaaaagaaaatgcaaagtcacctaagagacagtttaaatacataaaaagctcgatgccaaataaaactggatgggtcacttgataagtgggattgataaaaagcaagacagctgatattatataattcttatttgcttcgatatttactggggaaggtagaggggaaaagctatctaaattactcttaataagcatacaaatctctaatagtgaatcaaatgcatcattaaatatactaaattcctcaaactgatatgtcagatgtcaggtagtcatgaagacccaaaatagtctccatgggttttttgttgttgtttttttgagacagagtctcactctgttgcccaggctggagtgcagtggcaccatctcgactcactgcaacctctgtctcccgggttcaagccattctcccacctcagcctcccaagtagctgggattacaggcatgtgccaccacatttggctgatttttgtatttttagtagagacagggtttcactatgttacccaggctgttctcaaactcctgacctcaagtgattcacccaactcggcctcccaaagtgctgggatttcaggtgtgagccaccacgaccagccccttctctgtgttttaaaggcatttaagtataaattattaaactgcaggacagaacatattagctgacggtcatatgagtgaccttctctaaatgccaggaggatagaatccacttttcctttatcaatattttccttgctcaacttctgacatattaggtactcaataagtatgtgctgaaccaaaacgaacaaaaaaatgctgtcatcaaagtaacttccatctactcaagtaggctgcaacttcaaactgcccaaactagcaaatctctaataaagatgggctcagaagacatatcagcatgaataaccttctgaggaaaagacaacatggattctaaaagtggacatcacaccacaccagttcacccaaattctctgagaaaataaatatgtgtggctgggtgacggtggctcatgcctgtaatcccagcactttgggaggctgaggcgggtggatcatgaggtcaggagatcgagaccatcctagccaacatggtgaaaccccaactctactaaaaatacaaaaattagctgggtgtggtggtgagcacctgtagtcatagctactcgggaggctgaggcaggagaaacgcttgaacccgggaggcggaggttgtagtgagccgagatcgcaccactgcactccagcctgggcaacagagtgagactctgtctcaaaaaaaaaaaaaaaaaaaaaaaaaaaaaagacctgagtggccacaggatgagaacatttactgtagactggacataactgagacacagaaaattataggtagatgctgaggtacttccccaaatgaagaagtaaaaacagaagattgaaaatttttttagaaatgctatatttaacattttaatatattgtacaaaaaatatacagagaattccccattttgcagatgggatgatgagattcctaataatgaaataccacacgagttggaaaaataagggaacggagtgatggaaagggtttctaaatatattaaatgagaaacatttgcaaaaactaagatttatattcagcttagagaatgctttggcaagtataaaagctgtctaaatatgtgaagggttatctagcagaagacaaaccagacttgctctaagcagttcccgtgtagacaaaattgggcccaaagtggcaattccagaagggcacgcttcaactcaagctttctaaccatcagacctaactaaaaaggtggttcttaccttggattacctctaagagcccactgagatatgagtgttaaaaaattacatgcgaggaaatggcaggtatgttacagcatggacaaatgaaaagtaaggcatttacaggaaaaaaaatctaagctatacttaaaagactcatgccttcaagtcaaaaaaggaatttttgaataattatagaatattccctaaagacaatgtgatgttctatgcaaaaaaaaaaaaaaaaaaagggagggagggaggaccaaatcctattaggaaaaaactgtaaatcaagggtacccaatcgtttggcttccctgagccacactggaagaagagctgtcttgggccacacataaaatacactaaagtaacaatagctgatgagctaaaaaagaaaatcttaaaaaaaatctcataatgttttaagaaagtttacagatttgtgttgggccacattcaaagctgtcctgggccgcatgcagcctgtgggccatgggtcggacaagcttgctgtaaatagaacatattttcttatccttctaccaaatcacagtgtagttataactaaaatgcagttctgagtagttatcataaatccagaaagggaaagcaatgctgacaaagatcctggaaggaggtttcactggagattaaattaaaaagtcaagcatcttcagttgagaaacatgaaagcaaaggggcaatgtgatcaaaatcagaaaacgtatcaatatggtaaatactaatttattcaccttttatgcttgaaaagtatttctttatataacagataaaagaaacttgtggattgtgttaccacaatctacaagttaaaaatagattcaagtgctcggataaatgtaggtatattaggtccattcaggtcctacaggatagaagtgctatcagacgtgaggccctaaatttctgaggttaacatcttaacagataacaatgtttcacctgaaaacatcacttggtgccaatttagacagaacaattggttggacagaccccggacagacagactcaaggaggctggttggtatagacttccttccattcttttacctcagtatgtatgtgtgtgtaatatatacatacatattatactagaacatatatacattccttatctttatacacttagaatgctccttatatagctctgcaccctgaatttttcatttatcatttactcaacatcctaagacattaaaaattctttttttttttttagacagagacttgctctgtcaacaggctggagtgcagtggcaccatctcagctcactgcaacctccaactccctggtccaagcaattctcctgcctcagcctcctgagtagctgggatttcaggcacgtgccaccacgcccagctaatttttgtatttttagtagagatggggtttcaccatgttggccaggatggtctcgatctcctgacctcataatccgcccacctcggcctcctgaagtgctggaattacgggcatgagccaccgcacccggccagaaaaattctttcaaatactattccatggttgtaaatgtccatccttaaatataccatgatttattttcctataaatcttgctgctcatttaggtttattctcaattctcactaatatgaataatgttacaatgaacatctttgttcacaaatctttctatgtatcttaatttttcccctttaggataaattcctagatgtgcaattactgaattaaagaacgtttttaattttgccaatatatgttgccaaaatatctttcaaaaaaactaggcccaatgcacactccactagcagtttcagagattgtcccctcaccaccttcgacagcacagtcaactgtaaatctgataggttaaaaaaagagtatgtcatttaatctgcattcctttgattacttatcaggataaaaatgtttctcatatgcttcttggtcatttgtatttcttccttatgaactctgatcatgttctttgccagcaaaacttttctttctcttggccgacaaactttctgtggaaaaccagctgagatggaatcatttaaatatcagcaactgcagctccccctgctgacagataaattaccaccaccatcaagtgcccagtaaaaaaaagtgagctagaaccatacgcttgcctgtcttctgggctgctgctacaaatacaaattatacacggtaataaaaaagaaaatactgtgtatctaaactcatacttaacagagctgtgatggagaaggcaagggggacaagcgttttatttgttttttgttgttgttgttgttgttgttgttttttgagacggagtctcgctctgtggcccaggctggagagtagtggcgtgatctcagctcactgcaagctccgcctgctgggttcacaccattctcctgccacagcctcccgagtagctgggactacaggcacccaacaccacgcccggctaattttttttttttttttttttttagtagagacggggtttcaccatgttagccaggatggtcttgatctcctgacctcatgatgggcccgcctcggcctcccaaagtgctgggattacaggcgtgagccaccgtgcccggcccaaacgttttctaatgtgcaggaactaggcggggtgcagtggctcacacctgtaatcccagtactttgtggaggccgaggtgggtggatcacctgaggtcaggagttcaagaccagcctggccaacatggtgaaaccctgtctctactaaaaatataacaatcagccgggtgtggtggcacgtgcctgtagtccgagatactcaggaggctgaggaacgaggattgcttgaacccaggaggtggaggttgcagtgagccgagactgcgccactgcactccagcctgggcaacagagtgagactccatttaaaaaaaaaaaaactaatatgcaagaactaatgtcacaaacaattctaaaaatcaattccctgccaaatatactacctggcacatataaacatcacagacctaaatattcatttccctatactttaactatgtgaaaacactctaaattaccaaatgacactgggtggtcagcaaactagttctctttttccaaaagcaaaaacaacaaaaacacttttgccctttagcattcaaagaaagagtattaaaaatcttaattcttggcaatccttattccaaagttgcttgcacttatcagactgggaccaatagatccaaagagtaaggccaagactggcaaatgcatgtgactctcagcttttccactgataccctcctaaagatgcatgtcccaagtccagcaatacagtctttaacactcatttactaagtgccatcaagagcaagcagtgatggccgggtatggtggctcacgcctgtaatgccagcactttgggaggctgaggggggtggatcacctgaggtcaggagttcgcaaccagcctgaccaacatggtgacaccctgtctctactaaaaatacaaaaattagctgggcgtggtggcaggcacctgtaatcccagctatttgggaggctgaggcaggagaatcacttcaacctgggaggcagaggttgcagtgagccgagatcgcgccgttgcgctccagcctgggcaacaaagagcgaaattccgtctcaaaaaaaaaagaaacaaaaacagcaagcagtgaggataaaagacaagagcaagtcctcactctcaaagaacctagacactagctgggttcaaagtggagcaaactagcaatcagtacaatagaagtgctaggtctgcatatgcacactcacatgcacacacactaacagtttcagagattgtccccttaccacctttgacagcacagtcaactgcaaatctgataggtaaaaaatagtatgtcatttaatctgcattcctttgattatttatcagaataaaaatgtttctcatatgcttcttggtcatttgtatttctttatgaactctgatcataaagtgataatacctgggtccagaggaagcactcagtgtcagctactgttattactattatcactactgttattttgttttaaggctaatcaagtgaagcagtgggagtggagaaggaacaaagaaatctgtaactggctgtgatcaattaatagtaaacaccaatatacttggaccagccactactgttattaaagactagggggagtaagtttccagaacagggtagagtccatcttaagcagaggtaactgcttgtgtgaagacccagaggcaaagaacaacagggttcacagaaggaactgggcacaagctatctgtactactgcgtacaggatgctcaggaagaagtggagagatgatctggcaaaacatttcaactctaccttcaaagctagttgagccatggtggaagagggagggatatgatcatacgcttgaacatgcattttacaaggatcatgttggcagcgacttggaagagagaaagcagtcaaggagaatgattacaagacaacagaaggtcacgcagccaaaagggcgatgaaggtctggactcaaaaaggagaagtaggatgactaggaaaatattatgagctaggatctcaagaatgtggtgactagaatggcacaagaaggaacccagaggcctctcaaatccctgatttgagtgactggctgggtgacactaccgctcactaagatacgaagataggaagaggttggactggggaagtggataagatcattttaaaatgcccataagatggccagatgcagtggctcacgcctgtaatcccagcactttgggaggctgaggcaggtggatcacctgaggtcaggagttcaagcccagcctggccaacatggtgaaaccccatctctactaaaaatacaaaaactggccggacgtggtggcgcacacctgtaatcccagctacccggaggctgaggcaagagagtcgctggaacctgggaggcagaggctgccgtgagccgagaccgtgccactgcactccagcctgggggatagagcgagactccgtctcaatagtaataataataataaaaaaataaaataaaatgcccataggacatccaagtagagatgtccaggaagcaactgtgtatatgggattggagatcagaaaactagtcagagctggaaaaacacacatttgcaaatcatcggcatatagacggcaagtgaggcacaagtttatctaaggcattcctcataaactgcacagggtgagaggaagaagggtcaagggaaggcaaatactaatgtttttaggagcaaaagaggaaaaaagtctgcaaagaaaaccaagagtatgggccagacttggtgactcacacactttgggaggccgaggcaggtggatcacctgagatcaggagttcgagaccagcctggccaacatggtgaaacccatctctactaaaactacaaaaattagccagatgtggtggcgggcacctgtaatcccagctactggggaaactgaggcaggagaattgcttgaacccaggagacggaggttgcagtgagccgagatcacgccactgcactccagcctgggcaaaagagcaagactccgtctcaaaaaaaaaaaaaaaaaagtttcaaagataaaacaaaaatcttgttaaagataaatacatgagaagctaaataaataatctacttctttaagtcatgctatcaatttgcaccaaaattttcatttcctatgtgtaggtgtcgagggtctagtacccatgataaatgatatacacctgttctgggctgaattgtgttccccaaaagagatatgtagtactccaggggcctgggcacagtggcgcattcctgtaatcctagcactttgggaggccaaggccacaggatcgcttgagctcaggagttcaatatcagcctgggcaacatggcaagaccccatctctactaaaaatatttaaaaatagccagatgtggtagtgtgcacctgtagtcccagctactcaggaagctgaggtgggaggattacttgagtccaggggttagggggctggaggttgcagtgatccaagtgccactgcactccagcctgaatgacaaagggagaccctgtctcaaaaaaaaaaaaaaaaaaaaagagatatgtagtactcctaacattcagtacctcagaatgtgatcttagagacgggatcttcagaccaggtgcagtggctcacgcctgcaatctcagcactttaagaggccgaggtgggtggaccacttgaggtcaggagttcgagaccagcctggccaatgtggtgaaaccccatctctaccaaaaatgtaaaaattagctaggcacggtggcgagcacctgtaactccagctacttggaaggctaaggcagaagaatcacttgaacctaggaggaggaggttgcagtaagctgagatcaccccactgtactccagcctgggcaacaaagagagactctaaaaaaaaaaaaagagataggatcttcaaagaggtcataaagttaaaatgaggtcatcagagaggactctaatcccaatatgacttgtccttataaaaaaggggaaattgtggacacaaagaaatacacacagggaggctgggcgccgtggctcacgcctgtaatcccagcactttgggaggctgaggtgggcagatcacttaaggtcaggagtttgagaccagcctgggcaacaaggtgcagccctgtctctacaaaaaatacaaaatttaggctgggtgctgtggctcatgcctgtaatcccagcactttgggaggccaaggcaggcagatcacctgaggtcaggagttcaagaccggcctgggcaacatggtgaaaccctgtttctacaaaaaatacaaaaaattacctgggcatggtgacacgtgactgtaatcccagctacttaggaggctaaggaaggagaatcacctgaacctgagaggcagaggttgcagtgaaccgatattatgccactgcactccagcctgggcaacagagcaagactctgtctaaaaaaacaaaagaaatacacacagggagaactctacataaggactggagttatgctgccaccagaagctagaagagaggcttgaaacagatcctgtcccagttgcttcagagaaagcatgcctctgcccttagatttctagcctccagaacagggagacaataaatttctgttatttaagccactcagcatatgtcactctgtggcagcagccttagcaaacagatgtcataagaaaattcgcagctcaggtttactaagtacctaccaggtgctgttctaaacactctgcgtgaataaactcatttaatccttataaagtccactctaggatctaggtactatcattataccctttttacagtgtggacaccaaggttctaagaggttaatgagcttacccagtatcacatagccagagccctctctctcaccactagtgtatgaggagctattattaacagtaattacaataagagctggcgtggtggctcacgcctgtaatcccagcactttgggaggccaaggcgggtggatcacttgaggccaggagtttgagaccagcctggccaacatagtgaaaccccgtctctactaaaaatagaaaaataagccgggcatgctggcatgcgcctgtaatcccagctacttgagaggctgaggcaggagaattgcttgaactcaggagacacaggttgcagtgagccgagatcgtgccactgaactccagcctgggcgacacagcaagactccatctcaaaaaaaaaaaaaattagtaattacaataagaacagtagtagtccactgaaccaaacactgccctatgtcctttacagatataatacaaaagtcctctgaagtaagtgttattatttccagtatgaaggaggaacctgaatctcagagagattaagaaaatcgcccaaagtcacacggttaagagtgctgagattaggccgggcacggtggctcatgcctgtaatcccagcactttgggaggccgaggcgggtggatcacctgaggtcaggagtttaagaccagcctggccaagctggtgaaaccccatctctactaaaaataaaaaaaaaattagctggccatggtgacaggtgcctgtaatcccagctacttgggaggctgaggcaggagaatcacttgaacccaggaagtggaggttgcagtgagccaagatcacctggacaacaaagcgagactcttgtctcataaaaaaaaaaaaaggaagaagaatgctgagattatatctaattgctaacttaaggggatatacaatgaaaacctgtttttactaaaactttaagaacaagttaattttttttttttctttaatgagacaagagacaaggtctggctctatcacccaggctggactgcaggggcgcaatcacagttcactgcaacctccacctcccaggctcgagccatcctcccacctaggcctctcaagtagctgcaactacaggtgcacaccaccatgcctggctaattttcttttgtatttttagtagagatggggttttgccatgttgcccaggctgttctcaaactcgtgtgctccagcgatctgcctgttcagcctcctaaagtgctaggattacaggcgtgagccatcgcgtctggccaagttaaattttttaatgcctgactttgcagttcaatactagaaatatacatctataaattcaaaattcttgaagatcccaagagaacacatgtcctagattatgggcccttttgcgtgtgtatcccctcaaccactgttcaagaactattctctcggctgggcacggtggcccacgcctgtaatcccagcactttgggaggccgagttgggcggatcatgaggtcaggagatcgagaccatcctggctaacacggtgaaactccgtctctactaaaaatacaaaaaattagccgggcgtggtggcgggcgcctgtggtcccagctactcgggaggctgaggcaggagaatgacatgaacccaggaggcacagtttgcagtgagccgagattgcgccactgcactctagcctaggtgacagagtgaggctccgtctcaaaaaaacaaaaacaaaaacaaaaaaactattctctcagttagaacccttgccatttctctgacttccagacacagaaagagaagaaaaggaaggattgagatgctgttctttaaaatttttttttttttttgagacggagtctccctctgtcgcccagactggagtgcagtggcacgatctcggctcactgtaaactccgcctcccgggttcacgccattctcctgcctcagcctcccaagtagctgcaactacaggcgcctgccaccacgcccagctatttttttgtatttttagtagagacggggtttcaccgtgttagccaggatggtctcgatctcctgacctcatgatccgcccgcctcggcctcccaaagtgctgggattacaggcgtgagccactgcgcccagctaaaattttcaattttctatttaatttttaaaatctgatacaaacatcagaaagtgtaaaaagatataatgcaatgagaagtctccttcctactctgtcctctacctgaacaattcctagacctaacaggtaaccagtgccaccattttcttatttattcttctaaaggtttgtgttgttgctgttgtttgagacagagtctcgcttggtcagccaggctggaggacagcggcgtgatctcagctcactgcaagctccgtctcccgggctcaagcaattctcctgcctcagcctcccaagtagctgggattacaggtgtgtgccaccatgccccagctagtttttatattttcagtagagacggggtttcaccatattggccaggctggtctcagactcctgacctcaggtaatccacccaccttggactcccaaagtgctgggattacacgtgtgagccaccatgcccagccctaaagatcttttttttttttttttgcatacatacaccaatgcaaattatctttttctcctgtttttttttttccaaaaaacacaaagggtatcaaatcatacatactgttctgcatcttgctttcatcacttaactgtctgccttgcagatctttctatatcatattaaattatgttttaattctctcgttttgcttgtcaagaacagtttttacttcatttcaccatagttcagtctagcacacaaggcatccagcagccctaagaactacctgaaacaactgatgatggctccatgctacacactaaagaccctgtatcttttctctcctcctcatcttcatttcactcttttctccgactcactcaattctccttcctttccctattcctctcccatctcacccactccttagccctaaccctgacaactagaccctagtaacatcactgacattgcttagtcgtggctagaaatattcaggctttaaaaaggtacagacccctaacacagagaaaaagggataaataataatttccatgagaacttctaattaacgagagtgccttaaattgaggagttttggcttggagttattcttccttgttacttgcctcctctggcattttcatttgtgaagactgagtgagtgtgacgctattttctatacgcatggaaacaagcacatactcagtctaacatttacgcaatgcctgacagaacgacagagttcattctacaataagataattggaaacaaaatataagatctatataaaataaacatttgggctccaaaatatgcactttaattaacctatcatttctttttacttaaattaagtagctccaatctgaaactacatcttagaaatgttttaaggatattcaccaatgaaaaagagaataaagttccctctccccacttttattttccagcccacaaactcaatgctatcctccccgcaaaaaggacctttttttctgaccagacgaacactgtaatttttaaggtttctaagtaataaaaataggaagaaaacattaccccccaaaattggtttacacttagaagatgtttcccactgagcaaaggattggtaaggaacataatattaaggcaaccacctaactgcattcttaagtagtaacaggtggtaactcacgatatggagctgatttcctttctctattcctgccatgccagagacctctagtagaacttctgaggttactgtattacaacccaggttcagagagatttagaggtaaaaccttaaacactggaaatatctttaaaagtagggctttgtgtaccaaatacattcgttaaaacctaggaaactataaaatgaaatccaatgtattgatctcaatccccttgcctgcttcctaaagaggacagaggccaccaacactggtgctcaacacttgctaagtcgaaacactcttacacaggtcctctgattcttaacgggttcagaacttctggttgcattccccatgcaacccctccaactctacagggagaatgctggaaaaactgtgtcactttggcttcctgtatattaatataagcactcttatccagcaatagcagctgaaacataaatgaagatgagaactcagcctacatgacctaagatttcccacaagtccagatatttaggttacacacactgcactattgtctgatttctcctctgcatcaatctggaagtccacagagcagattagcacccaacaatcttaactaagctagtatcctactctgaagaaaggcgaagctggtggagggtttccaagactccttatccttctctgtccttcctcccatcccctccttacgtcttttctgtttgtttttatttaattttttttttaatgtatttttagtcacaagaaaatcaaagaagccacctacttaagtcttaagctctgccctttgcttagtcctaatggagagttctttggccatctatgtacaagagattagaggagccaaagagactggagaaccacatcaatgggagctttttcatctaaaggtcatctgtccacactgtccaaatgaggtttaccctgtgaaataaaacttggtgtaagtgctacctgctgagaaaaatagtatgaaatgtcacacaaaggactggggtgcagcaggaggactctgaaagagtcatacgtgtaaaccagcaggtcttagaatgccctaatatactatatgaagtttcagagtaaacaaatggttaatgacacatcttttgtaacacatgaatcagctactgatttgcaagagtgggacacaccctagtacctatgactctaaagtacctgtttgaaaagtggacctagatgtttgaattgccaacccatcctaagaccggaacataattttacaactatgtaagttgccataatttaaagttaaaaagatcactgcctttcattataatggaagttaatttgagaacttcattaaaacattcacaccgataatcaaagaacagtagagatacaaagtaaaatatagccaatcaatcctaggaagcaaacacaagaggcaagagaaatggcaggtaaaggaagtgaagaatagcaaattcaaaaactacaatattcccaattctaaagaaaaatgaataaaatgaggctggtaatgaaaaaataacacatcttaccttaagaggcatccaagtagcattcatagtgtcaggatataaagacaatactcagaaatgagcaagaagtcttagtaattccctcggttaccaagtataagcaggtaggaaaatcttttgtttcgagaaggtatctgaaagagaggattttcatttagactaaaaaataatcaagacaatgcaaatagtttaagctacctgggcagggattttgaagtactatttgcctcatcgcactaaaaaagtatagaaaatacagtcccctttagaaaagggcaaatgtgtgtctccatatatatgtgtgtagaaacatactttacataaaaagagaaataaatatgtaacacgtattttagataatgtaaaattgcttatcaaacaattagccaaaatcccagagagaataaagtaattttccagggtacttcataaacactaaacgtgatttgttaactaaccgtctaaagaaagacccttgccacatttaattatatttagtaaagtaaaacttctctaatcatcccgactgtcccaagattatgcttaagtttcagagtcaattccacatgaaaagtaaaacctattcttgactgaagtactagaaacaaataaaagacccttcttccccagagatcgttaaaagcagaccgagcaacttaattttgagggtgggaggaaggtaaatttgcctggaggcaggaggatggactaaatgacctctggtaggatcctcgttcaagtcctgggcctgtatacaattccagcttaaccagttactgcttcgcttaaaatggaggcttgcctgcgtagggacaaaaataacagcacccacttcttaaaaataaatgtcgaaaagtacccctttttaaataaaaataaaaaataaacacctctggagtggatgtgttcttgctatgcgtttgtcactgaggcttcgaagacttggcatcactttccttaccgctcaccggattttgggggaggagcggggggcgacagtttgactcttgacccaagtctcaggcggacttcagagccccacaggggcccccaactccagagccagagggagcggagaggcgagagcccgagatcgcacctccccccaccgcggaccccagtcccaaacccacccctcacctccccgcagtggggcgcctccttctgccccattcccattgttagggagggcagagcgcggggtgggctcagggcaggggcgcccgcggccgttgcccggctcgcttcaggaggggcgccccgcgggatgcggcttcccttcctctccgcgtcggtccgtcccacctcggctcggcctggcgccccgaggtccgctccgcgcccccggccgcggccccggcccgccccccgggcagccaggccctcaggccagtcggccggcagccggcgtcccaggcctacgagtgggcgctgggcgggggtccccgtgccccacacacgcgtcccctctcccccagccccgccgcttccagggccctcggcggcgcccgctccccgggccccgcggccccccgcctcccagccgggccgctccctcgagctcgtcgggtcagggacacctcctctacctcaccatcaccctggcccactcgtgcccccacccccaggggcaccagtgccaaaggcagctcccccagccccggacctacctgcacggttcaaccaagcctagaagtgggggcggggaatcttccgccctcctctggcgcccattggcccttcaggggcacatcgtgagcgccattggctgagcaatggtgtccgtcagagcgatggggcgggacagaagggggagagggatgctggtgccttggcgtctctgtctctgtgtatctcgttgtctctgtctctgtctcggcccttggaaacgagaggcttttggctgagaggactagaagggggcctgaggtgggaggaataggaataggaatcctgacagagcgtcacgccagttggccactctgaacgccctacctaagtcccctttaggttctcttctccatcacccccaacccctgcccctcacccctcgaggttctttcatccaggaagcgacgtgatgaaaactccaggccggaaggccatagggagagatgttatatatgtatataaaatatacacataaaaatgtttatatataaactcaaccagatatcagttcactagggcctggaaaggaaagggcacacatctcacagacagggaaggacttgagatagagccggtagaagaaggaatcaaaaatcactctaagagctggcaacagtggttacctcctgggagaggaactgagtgcctagggaaccagtgggcggaagacttacatatctcggcatatcatttgtatccattgatttttgcaccattcatcaagattccaatttaaagaaaaggatttaaatgtttaaataaggtcgcaaaaccaggggacagacaagataattgggcaggaaaattggcgcaacatgcagatttggggaggaatcttagcttttaatatgttcagctcccggtaacagggttttgtaaaacccagtgaaggtgtcccagaggcaactgaagttatggaacttgagagagggtagacaatcaggactagagaagatgcagggtcctctgcctaaagatagtgatctatgacatgctaaaggataaactcccaaagaagggtaataagacacccacagtaaaaggtaggaggacgaaaaagaaggtcagtgaggtaaaagaaacaatattaaagaggcatgaaaattaagggaggaagggtctgtggaaaatagaataataaaactatgagagaggccgggcacggtggctcacacctgtaatcccagcactttgggaggccaaggcgggtggatcacctgaggtcaggagttcgagaccagcctgcgcagcatggtgaaacccgatctctaatagaaatgcaaaaaaaaaattagccaagcgtggtggcgcgcctctgtaatcccagctactggaaaggctgaggtgggagaattgcttgaaccgggaggcggaggctgcagtgagccaagatcgcgccactgcactccagcctgggcgacacagtgagaccctgtttcaaaaaaaaaaaaaaaaaaaaaaaaacaacaaacaaactgtgagagcctcataggtcttacctctttacctctttaggctctggtaaccatgggacaataagaatgaaagccaaggccgggcacggtggctcacgcctgtaatcccagcattttgggaggccaaggtgggcggatcacaaggtcaggagatcaagaccatcctggccaacatggtgaaaccacgggcatggtggcgcatgcctgtaatcccagctactcgggaggctgaggcaggagaattgcttgaaccagggagtcagaggttccagtgagccgatatcacgccactgcactccagcctggatgacagagtgagactccgactcaaaaaaaaaaaaaaaaaaaaaaaaaacaacacctttatcgattaagaatcttttttctgagtttattaattctatttaaatcaaccccagaaaacaccttcaacacagcctctcatttcatatctgtaaaatggggcaaaaaaaaaaatagttcctaccctttagagttgttgtgaagattaaattagtgaatacatatgatggatttttttttcttttttcttttttatgagacacagtctcgctctgtctcccaggctggagtgcagtggcactatctcagctcactgcaagctccgccttccgggttcacgccattctcctgcctcagcctcctgagtagctgggactacaggcgtccgccagcatgcccgactaattttttgttatttttagtagatacggggtttcaccgtgttagccaggatggtctcaatctcctgacctcgtgatccgcccgacttggcctcccaagtgctgggattacaggcatgagccatggcgcccggcctgtgtgatggattttttaagagcctgactggcggggtgaggtggctcatgactgtaatcgcagcactttgagaggctgaggcaggtgaatcacttgaagccaggagttcgagaccagcctgggcaacatggcgagacctcgtctctacaaaaacacacacacaaaaattagctgggtatgatggtgcatgcctgtagtcccagctactcaggagactgaggtgagggtcgcttgagcctgggaggcagaggttgcagtcagccgagatctcaccactgcatttcagcctgggtgacagtgtaagaacctgtcaaaacaacaacaacaaaaaaaacaaaacaacaacaacaaaaaaacgcacgaaaaaaaccacataagctccttgagggcagaaactgtcccctagtcttctatattttatttcacacaatgtacagaagactaaatgaataattgttagctggtttttttttttaaaggggataagatcagttacaatgtctttttcctcagtcaatcacataagtatctaaaatgacattccaaagtaaggacaggagtttaaatcctgaactatggtatctaaagtaaacttgaactttccttatttttaaaaaattttggccgggcgcggtggctcacgcctgtaatcccagcactttgggaagctgaggcgggcagatcacaaggtcaagagatctagaccatccttgccaacatggtgaaaccccatctccactaaaaatacaaaaattagctgggcgtggtggcacggacctgtagtcctagctacttgggaggctgaggcaggagaaccgcttgaacccgggaggaggagactgcagtgagccgagatcacgccactgcactccagactggcgacagactgtctcaaaaaaaaaaaaaaaagaaaaagaaaaaagaaaagaaaaaaattccatacatagaattctgtgtggcattttagagaaaatcatggtgactagagacaccaggtgaaatttttttttttttttttttggtgacacaaccccaggagatcctgtgaacatgtgtcccttgaccaggtgaatttcaggagcttgcactagtcccaggttagctggcaccaggttggccctagtttgagtgccttccacataccaggtactgtgctggagaagtaacatcaaaaaggaaaatcaaatttcatcttcaataagcaatcacaatacactgtgatgagagttagggtgaaggaggttcaggttaccatgggcttatattaggagggcaaattctgtcttcaagtctttttgcttcaacagtagcgtttagatcttgtgggctgggcatggtggctctagcctgaaatcccagcactttgggagggtgaagtgggcagactgcttgagcccaggagttgcagattagcctggcaacatggcgaaaccccgtctctacaaaaaatacaaaagtcagccaggcatagtggtgcctgcctgtagtttcagctacttgggaggctgaggtaggaggatcgcttgaccccaggagttcaaggctgcagtgagctaccatcgagccacttcacttcagcctgggccgcagaataagaccctgtctgaaaaaaaaaatcttgtgatataataacagcttgtgcactcttcgatagctcagctggtagagcagagggctgtagactgcatagataataataacagtttgcgtttttgagtcaaagatgataccccagaatcattatcgaaaataatggttgatccattcacctgtgcctatgactgtgagccacattgtgaccaatctgtgagcaacatgggtgggaatgcagtttggggccatggaactcacttaacaggaagttccaatagcagtggatttaccatgttgcggctgtaggatcttggacaaatatttaatgacctctgtctctcagttctctcaataataaaacatccctccgagagttgctgtaaaggttaacatagggggagtcttgcaaatagtaggtgctaaaatcctgtcttgaaaaaaaaaaaaaaatatatatatatatatatatatatatatatatatgaagagatgagatcttcaattgtacagactgtccctgtacccattcatttgcatttcttttcctttacaataatacatatctatgatttcctttcattcccactgtcatcaatttagttagattactgggcagagatcaccagtggggctagagtaaaatgaaaataaatgtacattgactctaggtattcctaagtaatagcacagtttactgtgttctccctcataaatcctggtagctgaatgttgcctgcttttagcagttacgtttctgctcatctcaccctcaatgttcattaagaaaatagttattgaatggccaggctcactggctcacgcctgtaatctattacaggcgtgagccaccgtacccagccttggttatcatatttctaatttataatagtttttcttgttttcttattgttcattttttatagcatcctgttcttatattatggatatatatcttcaggtctcgctgaagaaataaagaggtgtatgtgtatatatgtgtgtgtgtattatctttatttttattttttgagatggaatcttactctgtcgcccaggctgtagtgcagtggcgcttttgggaggctgaggtggaaggatcacttaaggccaatatttggagaccagccagggcaacataacaagacccccatctctacaaaaaaattaaaaattagctggccatggtggtgagtgcctgtagtctcagctacttgggaggctgaggcaggaggattgcttgagcccaggaggttgaggggggaggtgagccatgattgagccactgcactccagcctaggtgacagagtgagaccccatctctaaaaaaaaagagagagagaaataaaatagttattgagcacctactgtatgtcaggtccaagaccctaaagatgtaaagatgaataaggtggtgaccctgccttccagtttccacaaaggtggggaatatggataaaagcagacaaagccattgccatgggataagggcagagaatagcatgtgcaaattatagaaggtgagggataatataccactttccagaaactgatggttcaatgaggctaaagcatggagttcaagaaaggaaaccagatgagattaactgcaatgtggttctcaaacttaaatgtgcataaaaactggccttgttgactgggcacagtgactcacaccggtaatccaagcactttgggaggtcgaggcgggcggatcgcttgaggtcaggagttcgaaactagcctggccaatgtggtgaaaccccatttctttttttttctttttcttttttttttttttttttttttgagacagagtctcgctgtcgtccaggctggagtgcagtggcgtgatctcggctcaccgcaagctccgcctcctgggttcacgccattctcctacctcagcctcccgagtagctgggactacaggcacccgctaccatgcccggctaatttttttgtatttttagtagagacggggtttcaccatgttagccaggatggtctcgatctcctgacctcgtgatccgtccgccttggcctcccaaagtgctgggattacaggcgtgagccaccgcgcccggcctgaaaccccatttctactaaaaatgcaaaaattagctgggtgtggtggtgcacacctatagtcccagctgctcaggaggttgaggcgggagaatcacttcaacctgggaggtggagatggagtaagccaagatcaagccactgcactccagcctgagtgacacagcgagactctgtctccaaaaaacaaacaaacgaacaaaaaactggccttgtttacatagtctcgcaagctccaagcctagagatcttgatggagcgggtcagagtgctgctgctcggagggctacactctgagaaccaccgatggagaagaagggcggggtcaacttgcagagctgtgctgggaggtgtgtgctgcagccttgagggggtgaagaacctttgagaggttttaagcctgcaagagatgtggtcacatttatattttagaaaaatcaccctgtgtgcaatatgaaaaatgaaacagagagggcaagactggagtcagggagagcagttaggaggctgctgcagaaacccaggcaagaaatcataaagacctgaaataaaacaatgccagtggggaacggggaagagaggccaaatccaaggggtatttaggagccagaattgagagggtgtgatgagtgttgatgggatacaggacaggatcctgagatggcttgcaggtcttcagctttgagtgacccatggaagcgaaggaagatgggaaggagggtgcctatcacacagagagaatgaaggtttgagaggcaagtgtagcttttgacattttgcttttgaaatgtctatgggacatcagaaataatctcaaaagaccacaagtcaggcagggcgcggtggctcacgcttgtaattccagcactttgggaggccgaggtgggcagatcacgaagtcaggagctcaagaccagcctggccaacatggtgaaaccccgtctctactaaaaattcaaaaattagctgggcatggtggcgggcacctgtaatcccagctacttgggaggctgaggcaggagaatcacttgaacctgggaggcggaggttgcaatgagctgggatcgagccatcgcactccagcctgggcaacaagagtaaaactctgcctaaaaaaaaaaaaaaaccatgagtcactggttaacagcctgagcggcagaaatctcacagttctgagtctgaatcctatctagcctggctctgaaactcacaatctggagctggggcttggtgcagtggctcaggcctgtaatcccagcactgtgggaggctgaggcaggtggattgcttgaggccaggagtttgagagcagcctggccaacatggtgaaaccccatctctactaaaaatacagttagccaggcatgatggtgtgcacctgtaatcccagctacttgggaggctgaggcacgacaatcgctggagcccaggaggcagacgttgcagtgagccgagattgtgctactgcactccagcctgggcaacacagcaacactgtctaaaaaaaaaaaaaaaaatgctgggcgcggtggtttacgtctgtaatcccacttttagaggctgaggtgggaggatcacctgaagccaggagctcaagaccagcctggccaacatggtaaaacccgccatcccctccctgccatgccccatctcccccaacactctcccaccctgtctctactaaaaatacaaaaattagccgggtgtggtggcacacacctataatctcagctacatgggaggctgaggcataagaattgcttgagcccggaaggtggaggttgcagtgagccaagatcgcaccactgcactccagcctgggtgacagagcaagactctctcttaaaaaaaaaaaaaaaaagaattttttttttaaatatagagatgggctttctgtgtttcccaggctatactcaagctcctgggctcaagctattctcctgcctctgccttcaaccagcctcaatcctccaattttcttattttttatatttttcaacaccttttaaattctacattctggccagctgcagtggctcatgcctataatccagcactttgagaggttgagatatgagacttgcttgaggccaggagtttgaggcttgcagtaagctagaatggcgccacggcacagcagcttgggagacagagcaagaccttgtctcaaaagaaaaagaatttaaatactacattctaggagatttcttcaaccttcaaattttgtattgaatttttaattttggcttttatttatttattttttttttgagacaggttctcactctgtcacccaggttggaatgcggtggcttgatctcagctcactgcaacctctgcctcctgggttcaagtgattctcctgcctcagcctcctgagtagctgggattgcaggcgtggtccagcatgcccagcttatttttgtattttcagtagagacggggtttcaccatattggccaggttggtctcaaactcctggcctcaagtgatccacatgcctcagcctcccaaggtgctgagattacaggtgtgagccactgcacccagccttggctatcatatttctaatttatgatagtttttcttgctttcttattgttcattttttatagcatcctgttcttatgttatggatatatatcttcaggtctcgctgaagaaataaagaggtgtatgtgtatatgtgtgtgtgtattatttttatttttattttttgagacggagtctcactctgttgcccaggctggagtgcagtggcacaatcccagctggctgcaacctctgcttcccaggttcaactgatcctcccacctcaatctcccaagtagctgggattacaggcacctgtcaccatgcccggctaatttttctttctttgtttcttttttttttttttttttttttttttgagatagagtctctgttgcccaggacggagtgcagtggtgtgatctcggctcactgcaagctccacctcctgggttcaagagattctcctgcctcagcctcccaagtagctgggattacaagcgtgtgccaccacacccagctaatttttgtatttttagtagagatggggtttcaccatgttgtccaggctgatctcaaactcctgacctcaaatgatccaccttcttcagcccgccaaagtgctgggattacatgcatgagccaccacaccagcaaaatttttgtatttttagtagagatagggtttcgccatatgtgtgtgtgttttaagtttttctgttttcatttctcttggcatatatacctcggaatggaattactgggtcatatgggagctctgtgttaaacacttgtgtcatatctaagaaaacttgctaatccaaaggtcataaagatgtatgtctatgttttcctctaaggccaacatggtgaaacactgtctctattaaaaaaataaaaactgggccgggcatggttgctcatgcctgtaatcccagcactttgggaggccaaggtgggtggatcacctgtggtcgggagttcgaggccagcctgatcaacatgcagaaaccccgtctctactaaaaatacaaaaaaattagcagggcatggtggcgcatgcctgtaatctcagctacttgggagctgaggcaggagaatcgcttgaacgcaggaggcagaggttgcggtgagccaagatcgtgccattgcactccagcctgggcaacaagagcaaaactcggtctcaaaaaaaaaaaaaaaaattagttgggcgtggtggcgcgcacctgtagtcccagctactccagaggctgaggcaggagaatggcttgaacccaggaggtggaggttgcagtgagctgagatcatgccactgcactccagcctggcaacagagcaacagagcaagactccatctaaaaacaaaaaaaagagttttctacttttcagtctaacaaatgttttataaacaaaggctttgttatattttgagttaatttttatagataatatgaggtgaggtttcaacttcattctattgtgtgtgggtatccagttgtcccaggaccattgtttgaaaagacttttttttctacactttctctcattgaattgtcttggcatatttgttaaaaatcagttgaccttggctgggcaccatggttcacacctgtaatcccagtattttgggaggccaaggcaagaagaccatttgagcccagaagttcaaaacccgcctgggcaatataggcacactccatttctaaaaataattattaaaaagattagctgggcaggccagacatggtggctcacgcctgtaatcccagcactttgggaggccaatgcaggtggatcacctgaggtcagaagttcaagaccagcctgaccaacatggagaaaccccatttctgctaaaaatacaaaattagtctggagtggtgactcatgcctgtaaatcccagctactagggaggctgaggcagaagaattgcttgaacccagaaggcggaggttgtggtgagccgagattgcgccattgcactccagcctgggcaacaagaatgaaactctgtctcaaaaaaaaaaagattagctgggcgtggtggcacatgcctgtggtcccagtgacttaggaggctgaggcagggggatcgggagacggaggctgcagtgagccttgatcactgcactccagcctgggtgacagagtgagaccctgtctcaaaaaagaaaaaaaatcagttgaccgtaatgtgagcactcatttctggactttcaattctattccattgatctatatgtcagtccttatgccagtgcccaggggctcaactactggtactgtgaattagattttgaatcaagaagcgtgagtcttccaattttgttcttatttttcaagattgttttgtctatttgaagttccttacaatttaatgtgaattttagaatcagcttgtccatttttgcaaaaaaggtagttgggattttgatagagattgtgttgagtctgtagatcaatttgggaggcattgctatgtgaagagtagtaagtgtttcaatccatgaacacacaatgtcttttcatgtatttaagtttaatttctttcaataatgttttgtagtttgcacttccttggttaaattcattcctaagttttttttggtgccattacaaatggaattgttttattaatttcatttttggattgttcatttctagtgtatagaaattcaactgagccaggtgtagtggtgcaccacctgtagtcccagctacttgggaggctgagtcaggaggattgcttgtggccatgtttgaggctatagtgcattataattgtgcctgtaaatgatcactgcattctagcctcggcaacatagtgcagtcttgtctcttaaaaaataaataaataaacaactgatttttgtacgttgatcttgtatcctccaactttgcaaaattaatttattactattaagactttgtggctgggcacggtggctcatgcctgtaatcccagcactttgggaggccaaggcgggcagatcacgaggtcaggagatcgagaccatcctggccaacacggtgaaaccccgtctctactaaaaatacaaaaaattagccaggcgcggtggcaggcacctgtagtcccagctacttgggaggctgaggcaggagaatggtgtgaacccgggtggcagagcttgcagtgagccaagatagcgccactgcagtccagcctgggcaaaagagtgagactccgtctcaaaaaaaaaaaaaaaaaaaagattttgctttattttgtgtttggtgtggatactttaggaaccaaaagataaataaataagaacaaggtctagcactttggtcaaatttattcctaagtgtgtgtttgtaaacgatattgtaaatgaattttcttagtttcattttcagcttgctaattgttactgtatagaaatacaatttatttatttatttactttttttttttttttttgagacagtctcgctctgttacccaggctggagtgcagtggtgtgatctcggctcactgcaacctctgcctcctgggttcaagcaattctcttgcctcagtctcccgaacagctgtgattacaggtgcgtgccgcaacccccagctaatttttgtatttttagtagagatgggttttcaccatgttggtcaggttagtctcaagatgttcttttttttttttttttttatcattttatttatttattttttaatttttatttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcctgcctttctattccacaaagccgccattgtcatcctggcccattctcaatgagctgttgggcacacctcccagacggggtggtggccgggcagaggggctcctcacttcccagtaggggcggccgggcagaggcgcccctcacctcccggacggggcggctggccgggcgggggggctgaccccccccccaccggtcaggttagtctcgaactcctgacctcatgatctgctcacctaggcctcccaaagtgctgggattataggcatgagccactgcgccaggccaattttttttatatcactcttacacctgcaactttgctgaatttgtttacttgttctgacggttttgtggattccttagaatttcctacatacaagatcatgtcatatgcaaatacatatggttttatttcttcctttctaatttgtgtggcttttatttctttttcttgctaatttcctggctagaaatttaagtataatgttgaatagaggtggcaagagtgaatatccttgtcttcttcctgatcttaggagaaaaacttatagtctttcatcattaagtattacctgtggggctggatgcgatggctcaagcctataatcacagcactttgggaggccaaggcgggtggatcatttgaggtcaggtgttcaagaccagcctggccaagatggtgaaacccccatctctactaaaaacatctctactaaaaatataaaaacttggcggggtgcagtggctcacacctgtaatctcaccactttaggaggccgaggcgggcagatcacgaggtcaggagatcaagaccatcccggctaacacagtgaaacccatctctactaaaaatacaaaaaaaaaaaaaagaaaattagctaggtgtcgtggcacacgcctgtagtcccagctacttgggaggctgaggcaggagaatcgcttgaacccgggagacagaggttgcagtgagccgagatcacaccactgcgctccagcctgggcgacagagcaagactccatctcaaaaaaaaaaataaacgtaaattagacaggcatggtggtgcgcacctgtagtcctagctactcaggaggctgaggaaggagaattgcttgaacctgggaggcagaggttgcagtgagtcgagagcatgccactgcactccagccagggtgacagagtaagactctgtctcaaaaaaaaaaaaaaggatttatgggaagtaattaaggtcaaatgaggtcataaagctgggcactgatctaatagaattagtgtctttatgagacgagaacccagagagctccctagctttctctctgccacatgaggccacttcaagaaggcaagccaggtaataaagcccacgctgaggtaggaggtggaactggactccagagatggggcttggacaccagaccaaattgatgactagctgaaacagggacagggtgaaagcagctttccataagacacgctcaaccagtgcaccatgtcagcttaccatttccatggcagaacccagagttaccaccccaccgccttttttttgagacggagtctcactctgtcgcccaggctggagtgcagtggcacagtcttggctcactgcaagctccacctcccgggttcaagcgattctcctgccttagcctcccgagtagctgggattacaggcgcctgccaccgcgccaaactgatttttgtatttttagtagagacagtgtttcaccatcttggccaggctggtcttgaacttttgacctcatgatccacctgccttggcctcccaaagtgctggaattacaggcctgagccactgtgctcagcctaccacccctttcaatggcaacaacttgacaacccagaagttatcagcctttttctagaaacgtctgtatagtctgccccttaatttgcatgtaattaaaggtcaatgtaaatatgactgcagaactgccctgagctgctactctggtcacactacctacagggtagccctgctctgcaaggagcagtccctctgctgttgctataggccactgcttcaataaaagttggcatctaggccaggtgcagtgggtaatgcctgtaatcccagcactctaggaggctgaggcgggtggatcatttgaggccaggagtttgagaccagcctggtcaacatggtgaaaccccatctctactaaaaatacaaaaaaattagttgggtgttttggcgcacacctgcactcccagctactcaggaggttgaggcgggagaatcacttgaacccaggaggcagagtctgcagtgagccactgcactccagcctgggtgacagagtgagaccctgtcccgaaaaaaaaaaaagttggcctctaacaccttcggtttgcccttgaattatttcctgggtgaagccaagaaccctctcagtctaagccccagttttgtggcttacctgccctgcatcaacaccagaaacttaaccctttgggaatctcgatcttggactttctagcctctagaaccatgagaaaatgatctgtattattaggctacccagtctatgatattctgttgtagcctggggtgactaagacattgagcctgtatgacttgaattttgttacctgcttggccccttgatggcatttcagtttgtgactcttggtttacgtgatcacgaagccaaaactgtttaggaaggaagcaaaatcaagacagattaaaaataaaaataaaaaataaaaggctgggcaccgtggctcacgccctcccagcacgttgggaggcaaaggtaggcagataacttgaggtcagcagttcaagaccagcctggccaacatgatgaaaccacatctctactaaaactacaaaaattagccaggcgtggtggtgggcacctgtaatcccaggtatttgagagggaggcaggagaatcacttgaacctgggaggtggaggttgcagtgagccgagatcacaccactgcactccagcctgggtgacagagcaagactctctctcaaaaaataaaataaaataaaataaaataaaataaaataaaataaaataaagagccgagcacgctggctcacacctgtaatcccacacttcgggagaaagaggtggcaggattgcttgagcccaggagtttgataccagcctaggtaacatggcaaaatcccatctcaattttaaaaaaattttaaaaaagaataatagggctgggcacgatggctcatgcctgtaatcccagcactttgggaggccaagatggatggatcacctgaggttgggagtttgcgaccagcctgaccaacatggagaaaccccatctccactaaaaatacaatattagcaggtcgtggtggcacatacctgtaatcccagctactcggaaggctgaggcaggagaatcgcttgaacctgggaggtggaggttgtggtgagccaagatcgtgccattgcactccagcttgggcaacaagagtgaaattccatctaaaaaaaaaaaaagaaagaaagaaataaggtattttacataaagattaaaaagaaattaaaaccattatttgaagataatggcttaaacagaaactctgcaaatccttagaataagaaagttcaggccaggtgtagtggcttgtgcctgtaatcccaatgcattgggaggctaaggtcggaggattgcttgagcccaggagtttgagacaagccgggtcaacataatgagatcgcatctctacaaaaaattgaaaaatgagccaggtgtggcagtgcgtgcctgtagtcctggctactcaggaggctgaggtgggaaggtcacttgagcctgaagagttcaaggctacagtgttatgatcatgccactgcactgcactccagcctgggagacagagcaagaccctgagaccctgtctcaaaaaacaaaataaaaaaccctcactatattgaacacaacatcaatgttcaatagccactctccttctccttttctaataaaattccacttttttgtgttccatcccaggaccacgatttatctaaactggtcattctggatcaataagtttggctaaaaataaataatatcgaaattggtcacaggaaatctattcttttttttttttttttttttttttttcagacaaagtctcactctgtcgcccaggctggagtgcagcagcatgatcttggctcactgcaacctctgcctcccgggttcaagcaattctctgcctcagcctcccaagtagctgggattacaggtgcctgccaccacgcctggctagtttttgtatttttagtagagatggggtttcaccatcttggccaggctggtcttgaactcctgaccttgcgttctacctgccttggcttcccaaagtgctgggtctgtcacccaggctggagtgcaatggtgcaatcatggctcactgcagcctcaacctccctgggctcagatgattctcccaccttagcctctcaagtagctgggattaaaggcatatgccaccatgcccagctaatttttctattttttttgtagagacagggcatccctaccttgcccaggctggtcttcaactcctggtttcaaaggatcctcctgcttcagcctcccaaagcactgggtctattattccctttcatattcaaacttaattctgcattttcaaggccttgaattttcaagggcagctttttctgtccctgaacttaatcttcagctcctctcacctcctgggaggttggggggtggggaagaaaagtcccaaccctctaatcctgctttggtcttttgccgccagcccccatcctgaagctaccagtcaatttgtttgcatacaagaagatatcactttggagattctaagtgtatacgaggaaatgaggtcaaagaccaaatatatatatttcactatatcacacttcaaacttttgtttactgtttcccttctcctactctattataaacctttgagggtggggactgtgagttatttatctttatattcccagtgtcaagagtgtttagctataatgggaatgaatctcaaagtttcttgaataaatgacaagaagaatcatagttgcatgaactaaattcattattctcagtccttgaggtaaatgaatatattgatattatgtctgcttactctttttttgcgagagagagaaagaggagggagggagggaaggaaggaaaaaaggaaggaaggcgaaaagagtgaaagaaaagagagagaaaaagagagagaaagaaggaaggggagggaaggaaggaaaagaaggagggaagaagggaaagggagggagaggaagaaaagaaagaagaaggaaggaaagaaagaaagaagaaaaggagggaggaaggaacgaagaaagggaaagaaggagggagggagggaaatgaaggaaagaaagaaaaaagaaagaaagaaaaaagaaaagaaaaggagggaggaaggaaggagggagggaaggatggaagaaagggaaagaaggagggaggaagggacatgaagagaataaagaaagaaagaagaaaagaaaagaaaaaagaaaagaaaagggagggctctgcgggcggcggcggcgcggggagccggttgcaggccgagatgctgcagatggacctgatcgacgcgacgggggacactcccggggccgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgcagttgtctcaggacacactgaataataattctctgggcaaaaagtacagttggcaggatcgggtgtctcgatcatcctcacccctgaagacaggggagcagacaccaccgcatgaacccatttgcctgagcgatgagctgcccccccagagcagccccgcccccaccacagatcgaggcacctccaccaacagcccacgctgctggagctggtgagcctgcggccgtgcttcagagactacagtgacgagagtgactcggccatcgtctacgacaactgtgcctccgtctcctcgccctatgagtcagccatcggagaggaatatgaggaggcctcccggccccagcctcctgcctgcctctccaaggactccacgcctgacgaacccgacgtccatttctccaagaagttcctgaacatcttcatgagtggccgctcccgctcctccagtgccgagtccttcgggctgttctcctgcatcatcaaccgggaggagcaggagcagacccaccggaccatattcaggtttgtgcctcgacacgaagacgaacctgagctggaagtggatgaccctctgctagtggagctccaggctgaagactactggtacgaggcctacaacatgcgcactggtgcccggggcatctttactgcctattacgccatcgaggtcaccaaggagcccgagcacatggcagccctggctaaaaacagtgactgggtggaccagttccgggtgaagttcctgggctcagtccaggttccctatcacaagggcgatgtcgtcctctctgccgctatgcaaaagattgccaccacccgccggctaaccgtgcactttaacccgccctccagctgtgtcctggagatcagcgtgcggggtgtgaagataggtatcaaggccgatgactcccaggaggccaaggggaataaatgtagccactttttccagttaaaaaacatctctttccgcggatatcatccaaagaacaacaagtactttgggttcatcaccaagcacctcgccgaccaccggtttgcctgccacgtctttgtgtctgaagactccaccaaagccctggcagagtccgtggggagagcattccagcagtttcacaagcagtttgtggagtacacctgccccacagaaaatatctacctggagtagccgcgcagccccgccctctgcgtcccccggccctcaggccagtgccaggacagctggctgctgacaggatgtggcactgcttgaggaggggcacctgccaccgccaggggatgaggaagtgggggccgctggctcagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccatacctcccctgccagggctcgggtgctctggctcctgccttgatgaagcccatgtcctgccttgatgaagcctgtgccacctgcaagtgcccgccctgcccctgtcccaacacccaccgaagagccctgagctcaggctgagcccagccacctcccaaggactttccagtgaggaaatggcaacacatggaagtgaagtccctgttctcagctctgtcatctgcagggcttctgggtggctcctgccactgacctcactggcatgctagcctgtggcaggcctaggacctcagcggggaggaggagctgctgcaaggccctatcccagcaggagagggaggcttcctgactgacacaggctagccccatcttggtcctgtcaccctggccccaactattaaagtgccatttcctgtcaaaaaaaaaaaaaaagaaaagaaaagaaaagggagggagggagggaggcaggaaggaaggaagagagggagggagggaagggaggaagaaagggaaagaaggagggagggagggaaatagaaagaaagaaggaaagaaaaagaaagaaagaaagagaaataaaataaaaattaaaaaaccataaggttaaagtaaaccctttttcttcatacagattaaaacacatgacttcaaattacagctttgcttcttaatagcttggtgatgtaggacgttatgtaacctctctgtgcctcagtttcctcatttataaaatagggcaataataatatctagcccataaggcattgtgaggattaaatgtgaaatgctgatcacaaatacctagcagcccaatagatactcactgtaataattattatttttataatttctgcaaaagtatggtgatgattcttgggttaacctaaaggcagattttcttttatttcttcctgtttcttttcttttccttgttcactttaaagaattaaaaagaaaattgattccagcattttggaataaaaatttgcatcaaaaagaatttattcattttattgacatacaaataaaatgtcatttgtttattcaataaacatttattaaatgtctggtaaatttcagacatcatgccaggcacagggatgacaatgacaataagatgtggtctctgccctcagggagctgatagtccaggagactgacaagtagacaggtgattacatgcaatgtaacaaaggctatgatgtcatacaagaagacaagtgggagtatgtgatgggagtatggttttgaccagttcctcctcttagatttatccctttttctttggctataaagcaaaagaattggtcctatttttttttcttaactttgcaaattaaaccataaattttaataactttataaagataaaaggcaagcggtcagattcagtggctcacacctataatcccaacactttgggaggccgaggcaggtggataacctgagatcaggagttcgagaccagcctggccaacatcgcgaaaccctgtctctactaaaaatacaaaaattagctaggtgtggtggcaggcacctgtaatcccagctactcaggaggctgaggcaggagaatcgcttgaacctgggaggcggagtttgcagtgagatgagatggagccattgctctccagcctgggctacagagcaagactctgtctcaaaacaaaacaaaacaaaacaaaacaaaaagatgagcaacttgaattatggaggacactagaaatagtgtttcctacagaatcagggcttcctaccaacatagtcacttctagggttttcgacctgaaaagttctgtggcatattgtttctttgctatccacttttttttccctatttttccccctctttctctcctctactttatctcctagagatctaggtagttcccaaaggaataatgctttacggagtctaatgttgatttattaggtaaaaacagaaaatgacttttttttttacccacaagttccataccaaaaaatgaatgtaaacttcttatgcagtttcacacattgaaaatgcaggttattttaattccattgcatttttcagaattctcaatcgcaatcctctgacaactgttgaagatccgtatctctttaaattactggcattaaaatatctgtaagtactatagtactcttgggagtcatgagatgatttatactctttttaaatttttcatcaaagattaagtattttgcatttaggctaaaatgtcataatttaaattttaactgagttattgaaaaacattattggcaaaggaaaggatgtgtaatggtcaagatagccagcaggggaaagagaacagtgttgaagaacccatatagatttggaacatgtagacacatggaggaatattacttaaccaagaaagcaaaggggaaaaggtgttcattattctaaaaaggaagaaaagagtaaataatcaagatgggtgaatgcaatatgaaaatgagaagtaagataatggtaaaaaaaaaaaacagtgtaagacctactcttgaatatcattaatttgatgatgcaaatcaactttaatttctttaataagagctctctggaattttgcggcaaataaactgttgaactggcttgttttatagggaagccaaaattgaagtaatcacatgtccttgaattatctttttaagtacagaattttttactggggttcatatcatgaatgtttcggctttcttcttcagagacgtgggaacaacgcaagtcccacttacaacacttaagaacattctcatgatgaccgttgaactggaaaaactgtaagttatttttttcttagacttattttcaccctgttgcgtttttaggtttgttttattattttcttaagtcaggtttattgagatataattttcatatactaacattcaccctttttaagtgtacaatttgatgagttttgacaaatgtatagttacataaccaccaccacattcccaatataaagcatttctgtcgcctcaaaaaggtccctcgtgtccctttgtagtcaatcacctcctcccaccgtcagcccctgttagctactaatctgatttcctatagttttgccttttccagaatatcttataaatgaaatcatatagcatgtagcctcttgtatttgacttctttcacttagcataattttttcttttttgagatggagtctcactgttgcccaggctgcagtgcagcggcatgacctagactcactgcaacctccacctcccaggttcaagtgattctcctgcctcagcctcctgagtagctgggattacaggcacatgccaccacgcctggctaatttttgtatttttagtagagacgaggtttcaccatgttggccaggctggtttggaagtcctgacctcaagtgatccgcccgccttggcttcccaaagtgctaggattacacgtgtgagccacctcacctggcctcacttatcatattattttttgaaattatgctgccatccatgttgctgcacccatcactacagctggccctccatatctgcaggttcctcatccatggattcaactgaacatggatggagaatacttgaaaaaaatgaaatatataaaataactataagacaataaaaacagtagaaaatttaaaatacagtataattatttacataccatttacactgtattaggtatttaaagtatacctgaggctatatacaaacattatgtcatttcatagaaaagacttcagcatctgtggactttggtgtcggcagggggtcctggagccaatcccctgcagacaccgagggacaactgttcactcctttttattgctcagtagtattccagttgtgtggaaaccccatctctactaaaaatacacaaattagccagatgtggtggcacacacctgtaatctcagctactcaggaggctgaggcacaagaagtgcttgaagctgggaggtggaggttgcagagtctcctttacacttgctgtcctccctccactgccgcctgacacactcctccccagcagtggcctcttcataggcaaatttaaggagcaccttttagtccttgtcctgcttgacttggccctgatgtttgaaattcttgataaatctttcttccggaaacacactctttctatgcttccaggaaatctttttcttggttctccagacaacttcttagactccttgaccaattccttcttgttgccaacaatggaaacaaaccagccctacctaagcaaagcacattaaaactcactagaaagatacaggggagggggcgcccactaaaccactaaagagacaggaggtggggagctgtaggaccaggtttgggaacctgcaagaatcaagaccagagcccctgaaatagcaagaagctggaagcacaggaactgtcagagccagatggctgtcactgcagtcagcgcctctgattgtttgtttttgagatggagtctcgctctgtcgcccaggctggagtgcagtggcatgatctcggctcactgcaacctccacctcccgggttcaagcaattctcctgcctcagcctcccgagtaactgggactacaggagcctgccaccatgcccgactagttctttatatttttaatagagatggggtttcaccatgttcgtctcaaactcctgaccccaggcgatccacttgcctcggcctcccaaagtgctgggattacaggcgtgagccaccatgcctggccagtttttgtatatttagtagagactggttttgccatgttggccaggttggtctcaaactcctgacctcaagtgatccatccacctccgcctcccaaagtgctgggattataggcatgaaccactgtgcccagccacctctgatagttttcatcgtcctcgggccactggctcccaaatcacggttccagacaaaagcttacaagtagtccagctttggccaggctcagtgtgatggttaatactgagtgccaacttgattggattgaaggatacaaaatattgatcttgggtgtgtccgtgagggtgttcccaaaggagattaacatttgagtcagcgggctgagaaaggcagacccacccttaatctgggtgggcacaagctaatcagctgccagcaaggctagaatataagcaggcagaaaaatgtgagagactggcttagcctcccagccaacatcttcctcccgtgctggatgcttcttaccctccaacatcggactccaagttcttcagttttggaactcagactggctctccttgctcctcagcctgcagacggcctattgtgggaccttgtgatcctgtgagttaatacttaataaactcctgtatatattccattaattctgtccctctagagaaccctgactaatacgctcagtgactcacacctgtaatcccagtactttgggaggctcaggcaggaggatggcttgagccccagagtcttcttcttctccttctccttgtccttctcttcccttcccctttctcctcttcctcttccttctcttcctcttcctcttcctctccttcctcttcctcttcttcctcttgtttgtttgagaaaggttctccctctgttgccaaggctggattgtagtggcacaattgtgactcactgcttctcagcctcctgagagcccaggagtttgaggctgcagtgagctatgatcacactaccacactcctgcctgggtgacagagcaagaccctgtctcaaaaaacaaacaaaaaactctggtatgatagaggtgaattgtctgttttatcctgataattctgcttaccttagtcccgtggttctcaactgggccaattttgctccccaagtgacatttggcaatatctgggcagaggtcaaggacgctgcttaacatctttttttttttttttttgagacacagttttgctcttgttgcccaggctggagtgaaatggcacgatctcgcctcactgcaacctctgtctcccgggttcaagcgattctcctgcctcagcctcccgagtagctgggattatgggcatgcaccatcacgcctggctaattttgtatttttagtagagatggggtttctccatgttggtcaggctggtctcaaactcccaaccttaggtgatcagcccacctcagcctcccaaagtgctgggattacaggtgtgagccacctcacctgtcctgcttaacgtcttaaaacacacaggacaattcccccataaaaaatgatgaccagccgaaaatgtcaacagtatcaaggtgaagaaattgccataaaggcttggtaaacagggatggtatgacgacactattgataggccacattaaaatacttagggccatatccattatccctgtttttatgatttcttctttgtccccatgcagtttcaggggcaaaataagggagtaagtcagaggtggttccaaatagacatctgggaatcttagggtgtaatatggccctcatggaggcccttgctgagcttagggcctgattctggaatcctagcattgccaagagaggcaggctggcaggtgagaagacaaataatgggagagcccacatatgttggaattcatttgatggtatctaagctggggtgattgtccccactagcattacatgactatggatccagttatttggagaaatccatttcctccacagggaatatatactacattagaaccaaagatggaatccttagtaaatggaatcatttggcaaaattcagttgtctgaaatttttgcataaaattctcttttttattttcattgagccaaataaataaagtatcaggtatttactggggtcaccattctttgattcattgattttttttttcagacaggatctcgctgtcacccacgttggagtgcagtggcataatctcagttcactgcaacctccacttcctgggcttaagtgattctcccacctcagcctcccaagtagctggaaatacaggcgcgtgccaccatgcctccattttctttctttttttttttttttaattgatcattcttgggtgtttctcgcagagggggatttggcagggtcataggacaatagtggagggaaggtcggcagataaacaagtgaacaaaggtctctggttttcctaggcagaggaccctgcgccttccgcagtctttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtatagaacaaaatgaaaagtctcccatgtctacccgcctctacacagacacggcaaccatccgacttctcagtcctttccccacctttcccccctttctactccacaaaaccgccattgtcatcatggcccgttctcaatgagctgttgggtacacctcccggacggggcggctggccgggcggggggctgacccccccacctccctcccggacggggtggctgccgggcggagacgctcctcaattcccagacggggcgactgccgggcggaggggctcctcacttctcagacagggcggttgccgggcggaggggctcctcacttctcagacagggcggttgccgggcggagggtctcctcacttctcagatggggcggccgggcagagacgctcctcacctcccagatggggtcacggccgggcagaggcgctcctcacatcccagacggggcggcggggcagaggcgctccccacatctcagacgatgggcggccgggcagagacgctcctcacttcctagatgggatggcggccgggcagagacgctcctccctttccagactgggcagccaggcagagacgctcctcacttcccagacggggtggcggccgggcagaggctgcaatctcggcactttgggaggccaaggcaggcggctgggaggtggaggttgtagccagccgagatcacgccactgcactccagcctgggcaccactgagcactgagtgaacgagactccgtctgcaatcccggcacctcgggaggccgaggctggcggatcactcgcggttaggagctggagaccagcccggccaacgcagcgaaaccccgtctccaccaaaaaaatacgaaaaccagtcaggcgtggcggcgcgtgcctgcaatcgcaggcacttggtaggctgaggcaggagaatcaggcagggaggttgcagtgagccgagatggcggcagtacagtccagcatcagagggagaccgtggaaagagagggagagggagaccgtggggagagggagagggagggggaggggagggggagagggagagggagaggtgcattttcttataaacccaatttcctctttagtgcaactctaccatttgaaaggaacctttctattgtaatttacaagctgtgaataaccgctatgtaattctttccaaggattaataaactgagagaggatttgaaccaacagaggtaggggaagattagaagggggatgcaagtggccacagatcttagaggcggccagcagagggcgctgctccaaggtgaaggtcgcaccctgagaggccatccttttttgtaggaccagactggggtgtaaggacagtgcctcatcctcacaacgacagacccgtgttctgggtgtggatttgcctcccttgcctgcgggacttctgctagcactgccgttcctagacttagaccatgctagaatgagtccaggaaccgaggagaggagatgggagtggctcctcccactgtggcccctaataattcacatgaagaatttttgctttccttgccagggacccgggactcagtgggtccagaggtcctagtgccaaaggaagaaatgtgtagatcaggaaatactattatggttttattcaactggaagccgaggctggccatttattgtatttatttatttatttatctatctatttatttatttatttagagacagaatctcactcttgtttcccaggctcccaggctcaagagatcctcctaccttagcctcctgagtagctggtactacagtcgcatgccaccttgcccagctaattttttttttttttgagacgcagtctcattttgttgcccaggctagagtgcagtggcgcggtcttggctcactgcaacctccacctcctgggttgaagcgattctcctgtctcagcctccggagtagctgggattacaggcatgtgccaccgcgcctggcaatttttttttttttagtagaggcggggtttcaccatgttggccaggctggtctcaactcctgaccttgtgatccgcctgcctcagcctcccaaagcactgggattgcagacataagccaccgcgcctgttttttttgttttgttttgttttctgacagagtctctgtcacccaggctggagtgcagtggtgtgatctcagctcactgcaacctctgcctcctgggttcaagcgattctcctgccttagcctcccaagtagctgggattataggcgcacaccactatgcccagctaatttttgtatttttagtagaggtggggtttcaccatgttggccaggctggtctcaaactcccgacttcaggtgatccacccacctcggcctcccaaagtgctgggattataggtgtgagccatcaagcccagccctgcccagctaatttttacactatgggcaagtatgctgcccaagagtgctctggaactcctgggctcaagtgatcttccttcctcggcctctcaatgtgcttggattacaagcatgagccaccttgcccagccgaagctggccatttaaagttcctcatgctgctgaatcaataaggatggaaggcggctactattatgggctaagtgtttgcatcctccccaaattctttttttttttttttttttgagatggagttttgctcttgttgcccaggctagagtgcagtggcgcgatctctgctcactgcaacctccacctttcaggttcaagtgattctcctgcctcagcctaccgagttagctgggattacaggcatacgccaccacacccggctaattttgtatttttagtagagatggggtttctccatgttggtcaggctggtctcaaactcccgacctcaggtaatctgctgacttcagcctcccaaagtgctgggattaccagcatgagccaccgcgcccggcccccaaattgttttttgttttttttttttgagacggagtctcgctctgtcacccaggctggagtgcagtggcatgatcttggctcactgcgagctctgcttcctgggttcacgccattctcctgcctcagcctcccgaatagctgggactacaggcgcccgccaccacgcctggctaattttttgtatttttagtggacacggggtttcaccgtgttagccaggatggtctcgatctcctgacctcgtgatctgcctgcctcagcctcccaaagtgctgggattacaggggtgagccaccacacccggcctcggcccccaaattcttatgttgaagccctcacctccatgtgatggtattagaaggtggggcctttgggacgtaattaggctgacagtgccccatgatgggatgagtgtcttaaaagaaaagaccaggtggtctggctagtggctcacccctgaaatcgcagcactttgggaggccaaggtgggtggatcacttgagatcaggcgtttgagaccagcctgggcaatatggtgaaaagccatctctactaaaaatacaaaaattagctgggcgtggtggcgcaagtctgtaatcccagctacttgggaggctgaggtgggagaatcgcttgaacccaggaggtggaggttgcagtgagcccagatcatgtcattgcactccagcctccaacctggacagagagagcatctggagagtctctgtctcaaaacaaaaagaaaaaaaaaagaagagaccagagagcctttcttctctttgtccaccaagtgaagatatggcaagaaggcagccatctgcaagctaggaaaagagcccttgccagcacccaattgtgctatcaccctgatatgggacttcccagcctccagaactgtgagtaatcaatgtctattgtttaagccacccagtatgtaatactgagctgactaaaaccatcaccgaactagcctctttacatatgattagcaagaggaaaatggctctgttacttaatggaggaaggaggctatgtctgaaagccaaaaattcactggggacacatcttagcaggctcttgaccctaagacctggttaatggaaaagtagagcaacccaataaaaacaagaccaccaagaagtcaggtcttatggaataaagtattgagtgtccctatgaggcacagaacccttcgaaaggggattggaagaagtggtgaagaaggcggctatgattatcaacttagacttcatcgccatttgtagaaggaggcttctaacagctatgttttatgttaattggctcttttctcttcttttttctttcaaccttatattaagagcactggcagaagctagcggttttggcatcctgtaattattagctgtataaccttggccaagtaactcaacctttctgtgcctcagttactcatctgtaaaacagggtaataagtctcaacctcgtacttatgttgttataaagatttaacactaggctgggcatggtggctcacacctgtaatcccagcactttgggaggccgaggagggtggatcacctgaggtcaggagttcaagaccagactggccaacatggcaaaaccctgtctctactaaaaatacaaaaaattagctgggtgtggtggcacgtgattgtaatcccagttactcgggaggctgaggcaggagaattgcttgaactaaacctgggaggcggaggttgcagtgagccaagatcgtgccactgcactctagcccaggcaacagagttagactctgtctcaaaaaaaaaaaaaaaaaaaaagtaacactttgaacaaaaaagaaaaaaataataaaatttaaaaaagatttaacaattgggccaggcatagtggctcatgcctgtaataccagcactttgggagcctgaagagggaggattacttgaacccaggagttccagaccagcctggacaacaaagcaagactttgtttctacttaaaaaaaaaaaaaaaacaccaaagtcaggtgtggtggtacacacctgtgatcccagctacttgggaggctgagatgggaggatcccttgagccttggaggttgaggctgcaatgagccatgatcataccactgcactccagcctaggcgacagagtgaggcccatgtcaaaaaaaaaaaaaatgatccccaacatttagcagcttaaaacaaaaaacatttattatatcacactttctgtgggccaggaatctgggagggacttagctgggtggttctgctcagttctcttgggatgtttcagtcaagcagtggcctggggctgcactcttatctgaagactcaattgggagaaaatatgcattcaaggtcactcattggttgttggcaggctgtagttccttactgaatattggttgaagacttcattggcttactacctggacttctccatagactgcttgaatgtcctccccacatagctagagtgaatgactaaaaaagagagagaacacacacagcccaggtaagagttcagtctttctaagtcattatatgaaagagattcttttttttttgagatggagtctcgctctgtcgccaggctggagtgcagcggcacgatcccagctcactgcaacctctgcctcctgggttcaagtgattctcctgcctcagcctcccaagtagctgggattacaggcgtgtgccactatgcccagctactttctgtatttttaatagagatggggttttaccatgttggccaggatggtcttgatctcttgaccttgtgatccacctgccttggcctcccaaagtgctgggattacaggcgtgagccaccacgcctggccgaaaaagattcttgcacacacatgtttatagtagcactattcacaattgtaaaaatgtggaaccagtccaaatgcccatcaatcaatgagtggctaaagaaactgtggtatagatatacagtggaatactactcagtcataaaaaggaatgaattaatggcatttgcagcaacctggacaggattggagactattattctttttttttttttttttttttttttgagatagagtctcacttggtcacccaggctggagtgcagttgtgcaatcttggctcactgcaagctctgcctcctgggttcacaccattctcctgcctcagcctcccaagtagctgagactacaggcgcctgccaccacgcccggctaattttttttttgtatttttagtagagaccgggtttcaccatgttagcctggatggtctcgatctcctgacctcgtgatccgcccacctcagcctcccaaagtgctgggattacaggcatgagccaccgcacccggcctattttttttttttttttttttttttttttttttttactaaccaggggtttaacataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaataaagaagattcatgctaagctgtggcagaggggggaaggtatgatcgggtgggggtgggataaggaatggccatggaagataactgggtcaggttggaccctgggctgggagggggagggcaaggcccctcaccacaacttaagccaaacctaagctgcccccaggtgccataggtccctgtcccagcagggaggctgatgggcctgggcccatgcccctccccacctttgggggtcagatagtggccacccaggtttgctgggttggggcctgatacaggctctgcatgcccattcgggctgcctgtggagagagaatggagtcactgtttaaccatgctacctgcctcagccccagcagaccacaggaggttggccccagactcactgagtgcctgcagcagccctacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttgggaccctaacttgtcccttgccaaggccaactggctgccctctggctgtggggaccgcaaggagggacccacaagctgctggcgaagtcgctgcttcagttctggcttgagccactccacagccacctgctctccacagaggtgtggctgcccttcctccagggcctttttggccatggcagcggtccagtgcgagctgaatttgagcagagcgatctgcccgggcgcaggtccggggctgggcagcagccgcgcctcctgcaggccgggacccagcggctgcagcgcgggcagcagcgcgggcagcagcgcggtgcgggtcagattcggcggcaggcagtcaacgctcagctcacacttcccggtgctgcggcacacgagcagcgggcaggacggccgcagcgggtggttgtgcagcgggcgatggcggcctgcgcgccgcgccgcgagctgcagcgggcatatgcgaagccgcggttcaggccgctgaaggtcatcatcaggcggaactcgtagaggcggcccacgcgctggaacagcaggatagctggtgctcatacacttcctgaggcagccgcccgatgaacacctctgacccagccggcggcgggctgcccacccagcctgggggtggcccgccatacttcctctgcccgttcacctgcaccaggcgatgcctgtctccctgacccacgcctccagcgccgccttcaccctctcacaccacagctcacaatcccgcttggactgcatggctctctattctcttttttttttttttttttttgagacgtagtttcactcttgttctccaggctggagtgcaatggcgggatcttggctcaccgcaacctccgcctcccgggttcaagcgattctcctgcctcagcctcccaagtagctgggattacaggcatgcgccaccatgcctggctaattttgtatttttagtagagacggggtttctccctgttggtcaggctggtctcaaactcccgacctcaggtgatccacccacctcggcctcgcatagtgctgggattacaggcatgagccaccgtgccccgtctatggagactattattctcagcgaagtaactcaggaatggaaaaccaaacatcgtacgttctcactcataaatgggagctaagctaggaggatgcaaaggcataagaatgacacagtggactttggggaatcagggggaaaggatgggaagggggtgagggataaaagactattaattgggtgcagtctatattgcttgggtgatgggtgcacacaaatttcacaaatcaccactaaagaacttacttacgtaaccaaacaccagctgttccccaatatcctatggaaataaaaatttttttttagaaaaagagttcggtctttctgtaacctaatcttggaagtgtatattatcacttcttccataggctatcagtctcccagaccaaccctgctacagggtaggggagactacatggtatgtgaataccagaaagtgggggccactggggactggctatttggaggatggttactacaaactatatttgtaattttttttttcttgagatggagtcttgctctgttgcccaggctggagtgcaatggcacgatctcagctcgctgcaacatccacctcctgcgttcaagtgattctcctgcctcagcctcccgagtagctgggattacaggcacgcaccaccacacccagctaattttttgtatttttaatagagatggggtttctccatgttggtcaggctggtctcaaacgcctgacctcaggtgatctgcccgcctcggcctcccagagtgctgggattacaggcccgagccatggtgcctggctatatttgtaatattttaaccactaaaaaaaaaaaaaagaagaagaagaagaagaaaaagaaacaagtatgggaaaatattaagatctgataaaaccgggttatacttatgcaggtattcattacattattctccataactttttaaatgtttaataataaaagtaaaaatattttccccttaaaaatgtgcagagcatacctcaaataatgttgacaaagaatcctaaagacaattattattattattattttttgagacaggttcttgctctgttgcccaggctggagtgcagtgatgccacctgagctcactgtaaactccgtctcccgagtttaagcaattctcctgtctcagcctcctgagcagctgggactacaggcgagcaccatcatacctggttaatttttatattttcagtagagacggggtttcatcatattgcacaggctggtcttgaactcctggcctcaagtgatccacccaccttggcctcccaaagtgctagcattacaggcatgagccactgcaccgggcctctcaaactcctgacctcaggtgatccacctgccttggcctcccaaagtcctggcattataggcgtgagccactgcgcccggccgatcttccttcctttctcccttcccctcttcttcttcttcttcttcttcttttttaattaatagagatgggattttgccatgttgcttaggctggtttcaaactcctgggctcaagctatctgctcgcttcagcttcccaaagtcctgggattaagggcgtgagccactgcgcctggccccagtaaggatttaaaagctcaggaattattagtcagcttccttttttgttcatcctgttgtttgttcatttcagtctattccctttttataatttccttcttcataaggactatttctccttgtacttttgtgagaattcccgtaacttgtaatcccagctacttgggaggctgaggcaggagaatcacttgaaccgggaggcggaggttgcggtgagccgagatcaagccattgcactccagcctgggcaacaagagcaaaactcggtcttggaaaaaaaaaaaaaagaaaagaaaagaaaaaagaaaggaaggaagatcctcattggacagagcaaaaagcagaattgatggcactgaaaatgaaatcagcagctgatgtacaagttccagaatgtctcctagagtaacaaggaaatccgggtgtggtagtttatgcctgtcatccaagcactttgtgaggccaaggaggttagttagcttgagcccaggagttggagaccagcctggccaacatggtgaaaccccatctctacagaaaatataaaagttagctgggtttggtggtgggtacctgtagtcccagctactctggaggcgaaggagggaggatcacctgagtcccgcgaggtcaaggccacagtgagccttgatagagttttgccactgcactccagcctaagcaacagtgagaccctgtctcaataaacaaacaaacaaacaaataaataattgtagagacagaagataaaatggagcccggtgcagtggctcacgcctgtaatcccagaactttgggaggctgaggtgggcagattacttggcccaggagtttgagaccagtctgcccaacatggtgaaaccccgtctctactaaaaatacaaaaattagccaggcatggtggtgtgtgcctataatcccagctacttgagaggctgagacaggagaatcgattgaacccaggaggtggaggttgcagtgagctgagatcacaccactgcactccagcctgggtgacaaagccagactctgtctcaaaaaaaaaaaaaaaaaaaaaaggctgagcacggtggctcatgcctgtaatcccagcactttgagaggctgagccgggcagatcacctaaggtcgggagtttgagaccagcctgaccaacatggagaaaccccgtctctgccaaaaatacagtattagcaggtcgtggtggcacatgcctgtaatcccagctacctgggaggctgaggcaggagaatcgcttgaacctgggaggtggaggttgcagtgagccgagattgtgccactgcactccagactgggcaacaagagtgagactctgtctcaaaaaaaaaaaaaaaaaaaagagagagagacagggtttcaccaggttggccaggctggtcttggactcctgacctcaagtgatctgcccgcctcagcctcccaaagtgctgggattactggtgtgggccactgcatctggctcccaccatctctattaaaataagataaaataaacataaaataatgaaccgacaaaataataatacaattcattgtaagtaaaatgctatcctgagttctgtgagtcattctggataattcaaattctctagaattaccacctcagctgactttttttttttttttttgtagagaccaggctggtcttgaattcttgagctcaagtgatccgcttccctcagtctcccaaagtgctggaattacatgtgtgagccactgagcctggcctacaaattctttattatacaacacacagtagatgctcaataaatatttgctaagcagaaacatacactcaaaataccagaaattatcaaggaagttgccagttggtctcttgggttcttcctcccgacaggtatacacacctattgtaaagatgaacacattaggctgtgagaaaccaatactgttaaacattccaatcaggtgacaaactccctgggctctggtttatattaccaagcaacctgatgataacttggcttcctgtgtggcttgtttatagaaagagaatgctacccaggctgacgtgagttgcatttctgagttgatttctcactgtaaattaataaactggcattctggctacatagatcagtctctttgaactctttgtaccttccaccattagtgtgatttctaaggctgcaagccagacactgcccaagacccagcactggactctggtgagttcttccagctgttgccaccccaggaggctctgggagcccctgggaaccatccagcttgctctctgtctctacatttcagggtgtgggtttcagggcattcacaacattcctgcaacagaagagttttgggaacacccccagcaggatgtgggtgatttgaatgtatgtcagagatgtggttgtaactgagaaatcttaagcctagtgaattttattccacttgacttaaataaagagcacgtgaaagaaggggatctgaggacatctatgaacagggccccgagggcatgaacttactagtgtttatatgactagtgtttatctgggcctgtctagtctggagaacctgactctggtgtacccaagctttgcagtggctgtagaggtttgctcttttggagggagaagataattcattcctccaacacctgaatgagggtagattaacccacctccttcagctgcaatttggcaaatttctcttctttgatttaatgctcaacggacaaatttcctttcttcttcttcttcttcttcttcttcttcttcttcttcttcttcttcttcttcttcttcttcttcttcctcttcttctttttttctcctcttcttcttcttcttctcctccttctccttcttctccttcttcttttctcttccttctcctcctccttcctcctcctcctcttcctactcttcttcctcttcctctcctcctcctcttcctcctcctcttccttcttcttcttctttctttttttttcggttttgagacagggtctccgtcacccaggctggagtgcagtggcacgatctcggctcactgcaacctccacctcctaggctcaagcgatcctcccacctcagcttcccatgtggctgggaccaaggcgtgagctaccatgcccggctaatttttgtattttttgtagagacagggtctctccatgttgctcaggctggtcttgaactcctgagctcaagagatcctcctgtctcaggctcccaaagtcctgggattacaagcacgagccaccatgcccggcctcaacaggcaaccttctgattaataattagacctctgtgccggccgtcgtggctgatgcctgtaattccagcactttggaaggccaaggcgggtggatggcttgaggtcgggcgtttgagaccagcctggccaacacggtgaaaccccgtctctgctaaatatacaaaaattagcctggcatggtggcgtatgcctgtaatcccagctacttgggaggctgaggcacgagaatcgcttgaacccgggaggcagaggttacagtgagctgtcatatataatgaaacagttttactaaacttaggaagcagtgacttggtgtctctagaaattgcctaacatacacattccaggatacattctctgtcatctggaatctcctcccttccacaaacccacgctgtcttaagcactattttcctatttgttgttgacctaatctagaaaaaagcggccatcactctttctcccccactcagtccctcagtcccgaaacacccttattctccgcacttgtcaccccaccctctgctgcccccaccgcagcgcgcaaacgcacacgagtttaaagtttaggctgtgatgctatcctcgcccgcagatcacaggacagacattctcggggacaactttgcgaggccatgtgctcgtcccccttaggaaggaagagggagaaatccctgcggctcggttttgttccaatggtctgctcagcgagtgattcccgtttccccaaaggctgcccctcattagcatgaacggggacgcgggtgtggagaaggggttagaggagagaaagcaagcaaaagcccaggctcacttttagagcctgggaaccctgtctgcaaaaatgacagctagagctttctggctcctctgtttaatcgtcggatcatcccccgaagctccggtggagagaaaaagtaagatcggtgtagtgcggagccctgggagcggagcggggatctggggagggggcgcccaggcctcagccgccggccgacaaccgggccaccttccgtgaggccgcacacgctcccacaggcccgcgcctggcgcaagccgagaaccgcgcgtcgccgcgccgcgggcccgcgacggaggaagccccgagacgcgcgcgctcacgggccctacgcttccccgccgcccggccgcgcgcgcgcgccgccgagggccccgccggccctgcccaccccaaccggccgcgcgccgttgtgccggcccccggctcgccgcccgcgccgccgccgcgcctcagcttcagattcggcctcagtcagccgcgcagggacgcggagcccggcgccgagctctgcgcttgcgcttgccgggcgggcatggacgggcgagaggcgttctgcaagcgcgaaatcggtgagcccggccgccgcgccgccgccccgcgagcctttccgagtcccggagaatcctgcacgcgagatcccagggcgcccgacccatgcgggccgtttcgctgttgctaaaaaccaacgcccagggactgggagaggaactggggttcccaaactgttttttggaagcagcgatgaacgggatagtgcatgacgtggacgtgctgggcgcgggcatctggctggtgaccctgctggtggatcgggacgggctgtacaagatgaaccgcctgtacctcactcacccccgacgtcttcttcttccgagtccacatgttagtcctggactcctccagctgcaataaaccgtgtccagagtttaaacctggtattgaaactgagctgaatgacgctgcatatgtactttataccaccgtttgtaacgtgggtgccacagcccgggctgtgggtcgtccagtctttttttgggacggatgggggacagtattgtaacatgattaggatttagacgacaggtattatttccgccactgtgatttaagcaccgtcagccccacccccacgggtgagaacggcagctgttggcacaaagcgggctgtcaataaatagatgttgacaaatggagtgagcgaccaccaaacaccattgccagaagggactgtacagaactgagtttagaaaagctgcttttttgggggagtgtgtggagggttggtagcggggaatacccactcccacatcttttttttttttttttttttttttttagacagagtctcgctctgttgcccaggctggagtgcaatggcgccatctcagctcactgcaacctccgtcccccaggttcaagccattctcctgccctcagcctcccaagtagctgggattacaggctgagccactgcgcccagccccactcccacatctttctaggcatgtgctctgggaaatcctgatacaatgtgataaggacctttgttctgtaatgtgggctggttacgtattgctttcccttccccacaccccgtgctactttttgtatttttagtacagatggggtttcaccatgttggctaggctggtctcaaactcctgacctcaagtaatctgcccgcctcggcctcccaaagtgctaggattaaaggcgtgagccactgcactggcctggttgggttggttatcttctaaaggtcgctagactgtttccaccttgcctgtagactaaatatcagtttcaacttgtgcagcaagatagtagattgcagcttaggtatttcttaaaggccttatattttctgtttcatggcatttaaaagacgctatgaattaatgttctggttattttgtccaggcagcaggtatattgtgatgggccacatctaccataagagagggcagcttcctacagctctgctccaggtcctgagaggccatctctgtccaggggatggactgctgaggagcagcagcagctatgtgaaaaggtttaacccaaaaagggaagggcaaattcaaggtgcaattcatacccaatgcatttgaaacaaccatcctggcatttctggatcacaagagacatcggcaacaagacatgaaaggtctatcttcatgtaatgggtcctcctttagaagagagcccaaagctactctatgaatgacctgcatagttacaactgtaatctcgaaggtgtcactttgttatttacaagatgcttcttaaatgggctgctcctgagctcagtgtcaaggtgattcaactgttgtgccagacagtgatttacacagctcagataactgacctgtctagttaacagatcactgcttcatgtttttaaatattttaatttaatacattctttagtagaaatagtccacaaaacattttcctgaatttaaatacacaacttttatatcatgtatcaaacctgattttatattcaaacctgatttatattcaaaacttatatgtgaagattaaattcttcacataacagtaagcgcactagtcaaaagacatttacctatgaaacgtcatttagatcaaacacaagggtcaaagcccaggacaaggattaaaattttacacttaaaaagtaccaagccgggcgcggtggctcacacctgtaatcccagcactttgagaggccgaggcgggtggatcacctgaggtccggagttcgagaccaggctgaccaacatggaaaaaccctgtctctactaaaaatacaaaaattagccgggtgtggtggcacatgcctgtaatcccagctgagggaggctgaggcaggagaatcacttgaacccaggaggcagaggttgtggtgagccgagatcgcgccagcctgggcaacaagagcaaaactccgtctcaaaaacaaacaaagtgtacaaaagggccagtgtgcggatgggtggattaaaaaaataaattttaaaaaagtgccaaagggcttacttcaggcaaaagtgttcctgatgtaccaaagagtaagatatagtttattttcatgcctccctgctcctaataatgtatgttttgtgctgaactggcagctatcccaatgtgaactgtattctgagtgtatctgatatcatttttctattaagaccaagtataatgtttgcttgtaaagcaataaatcttgctttgaaattagaccttggatgcacctgtttatttttgttttgttttgttttagcctttgagccctaaaggtttgagaaaaagcctttctcaaattcattccccaaaccttggaaccaatattaaccaatgacagctcacaagcaagtgaattctaaacatttttcagttggttttaaaaaggtttaatcactagctaaattaaatattgattttatacctgagtccacaaagacatgagagtattttttcagaagataaggctgtacttcagtttataagaagtacggtgaacagagacaccactaatgcatagatgaagatgactgcctaaagagagacaggggaaggaatttcactggagagagagcagcctatttggcctcacggtgatgcactcaggaaggtcagaatgtgtcctgacgctgtccatggcacccagtagtagcactgtacacataaaggacatccaggacgggacgctagggaatcacaggagccaagaggcaacagcctaacattacaatacctgatactattatttgttccaattatggggcagacaggtaataaagagttgagaggttctgagtgttctatggtaaagcactactgagagatttctagagtattttccaaaaatgagttttgtccaaatttattataaattttactagaattgctttttgggagtcagatgcattattgcatgatagaattatagctaatgaagagcttctgagctagttttctttaagataaaaaaaattaactcaggcataactcaggccagtcaaatcaaagttgaatttttaaatgtcaaaaggctaggccgggagctgtgactcacacctgtaatcccagcactttgggagaccaaggcgggtggatcacaaggtcaggagtttgagaccagcctggccaacatagcgaaactctgtctctactaaaaatacaaaaattagctgggcatggtggtgcatgcctgtaatcccagctattggggggcaggaggatcgcttgaacctagtaggcagaggttgcagtgagccgagatcatgccactgccctccagcctgggcaacagagcgagactctgtctgaaacaacaacaaaaagtatatctatatggctaatttctttagttgaatttggttcaaattggatcaagtggtataatcttctaagaaaagtcttttagtatctcactccaagtatctagaaataccttagaatgtttcaaattattaaaaatacttctcggttggctcttccctccacctcctcaagtacttcattattttatccatggaatatccccattctcacattaagggcaagaaatctgagacctatggtaatagtttcttttttttttttttttttgagaaggagtttcgctcttgttgcctaggctggagtgtaatggcatgatgtcagctcaccgcaacctctccctcctgggttcaagtgattctcctgctctagcctcccaagtagctgggattacaggcatgcgccactttacctagctaatttttttttttttttttttttgtatttttagtagagatggggtttctccatgtttgtcaggctggtttcaaactcccaacctcaggtgatccacctgccttggcctcccaaagtgctgggattatacgtgtgagccaccacgcccagccgtatcatgatagtttcaatcaggaagagtgaaagctgtaataaccatgtaactttgtctaactaagtgtgcagagatctgaaagtccaccaggttggctctttaacataaagaagtagagagtttgcctaaaggaattagcagaaatagggaaataacttttatttgcagatcccaggaaggtagattacaaacaacagcaaatcttagtgtctctaaataacactctaggccatttggaatataaaaaggtaattattttacttcagaaaatatctccaaaagttcactttttttttgagacagagtcttgctgtgtcgctcaggctggagtgcagtggcacaatctcagctcactacaacctctgcctccccagttcaagccatcctcccacctcagcctcctgagtagctgggactacaggtgtgtgccacttgtccagctaaattgttgtatttttagtagaaacagggtttcaccatgttggtcaggcaggtctctaactcctgaccttgtgatctgcccgcttcagcctcccagagtgctgggattataggcgtgagccaccatgcccagccacaattttatttaaacctcctgtagaatttggataggagaataaaagctttaccaataggaaaatacttttcatgaaatggtttcaaggattgtgaacttggcaggtgaagcataacagttattgaaaatacttttagccaaggaaatctactgatgcaaattaaatatatttacaagcccaaggcctgtggtagaaacatcctaagagtatcacaaatgtacagtttactgcctggattattgaaagcaaaatagctgtgttatatagatcttaatagcagaagctttcaaagattactcacagaaaagcagctttcagaactcattatgttctaaaaaatgtatgtttttctttcttttttattttttttgagatgaagtctcactcttgtcccccaggctggagtgcaatggcgtgatcacggctcactgcaacctccgcctcccaggttcaagtgattctcctgcctcagcctccctagtagctgggatttcaggtgcctgccaccatgcctggctaatttttgtacttttagtagagatggggtttcaccatgttggccaggttggtctcaaattcctgacctcaggtgatcccccctgcctcggcctcccaaagtgctggggttacaggcgtgggccaccacacctggccaggaatgtgtgtttttcaaaaattacttttgaaagactaaagccctatagttgataaaactataaaatgtctttatgtatttgtatggtgatagaaactgtaaaacactttataccattaaatacacatgaaattaatatcttcctggtctcaggatttccataaaatttaccctttttaatttggcaatgctaacagctacagaagacatattaccaccaaccaaccgttgcttcattagaaactgcaccaaatccaatgtcaaaaacattactttatttttctagtatgaaatgtcctattacatacaaaagaattgctgtttagaatttgccacaatttgttgaaaacatagcaatctattgcctacaggtaggaaagttcttgctgcaacaaattttaaatgattaagcccatatatatttctatatatatgaataaatagtgcagaaatactgtgacgtgatgagatgcagaataattttataattcattaaaatgtagaattcttgcatcagcacagtgcatacaatatgtaactttttttaaaaagtaaaaggacaaaataatccatatttaagtatttccatcttaatattttaagcaaaaatgttttcatgttttcatattgagtgattagtctctttagtttgtaaacataggtttaagtgacatcttcatgtacaaaaaggaatgggcttcattagataaaattaagccagaataacctgtacacctgagcctgtaataagaaagaattgggaactgtagcaacatctttcttttaagaaaccaaggtctgggaaaggttttgcatagcagggaaacgttgaaaggaaggaaacttttaaaagcaataattagataaattccagaagttgataggacaaagctaatatgagttagaataaaatctagtagaatttttgcaaagctgcataatccagctatggcagattttatagaagctattaccacaatgcagtaatacaatgtgtaagaacattgaaaggaagaacatgcaaaatacatcttcctcattttcttcctactgcttacactacttttccttacatggaagaaacaaacaaaccaacaagcaaaaaacaaacccaatcaacaaataacacagaggatgagatcatctaacaaaaaatgtccttcatacaatataagtagctgtctgtaattggtaatttgcccagtatcacagaatgtacagatgaaggcaatgtgtatcttgtcgcattacctttttcgttagtatgatcaactgatgcgacaggattagcacccctgaagattcttctctgacgtgatgacaattgactgggaatgataaaacgaggggccactgctgtccaggagaattccaggtacaattagattcttttgcctttcatgaccttgcagccctccctccccacagaggcttacagataatcattagcacacattcaaagacacctctgtctgtgggagaaaaactatctccatttattttgtttcacatacatccatagttgaattttaatacaaaaagaaaaattagaatctgacaaatgtttacaaagaagataccttcaaatagattttactcatttcaacctggtgtggagtaattgacaaattgtactgttatattcaagtcaccagagtctgtagtccaggaccacttagcccaacctttatgcaagcttgattttaatctaccatgaacaataaactcattgttgattcgcagttgtgtgtgtgtgcacatgtgtacatagcagctcctttcatagaaagaaaagacatctagaggttgtcttgtacttttacgtacaggaatcattgataagatatggatggattatatgtaaccgtggctggattttataagaaaaaataattagttgacaaatgagggcagcaataaaaaagcatcttttttgcaacaataaataaatacagtcaaaagttttctttgagactctaaaccagcttcttcactgaagagcagacgtggcatttccatggagttatacttgaccccacagtatcattgtttcttgctttctttttcttttttttttttaataaacaaaattttctcgcttctgccacaataataaaaccatttgatcttgacaagataatggtgtcgttgacttttcttttttctttttcttttcttcctttttttgtttttgaaacggagttttgttcttgtcacccaggctggagtgcaatggctcaatctcggctcaatacaacctctgcctcccgggttccagcgattctcctgcctcagcctcccaagtagctgggattacaggcataggccaccatgcacagctaattttgtatttttggtagagacggggtttctccatattggtcaggctggtctcgaactcccgacctcagatgatccgcccgccttggcctcccaaagtgctgggattacaggcgtgagccaccgcacctggcaactttgcttttttcttgtccattggacaaaattggccaataatataattggactgttatgaccaataaaaacaaagtttaggtcaagtcttgtcaggatagcctcactaaaaagatctggctccttaatttaaaatagttcaggcaacaagattcttgctgtgttttatgttaggttaacatgctgaactttaggaagctgtagactgcagtttgttgttgtgagacctacagagtatagaaaaagggaacaattgagcacctttcatttttgaaaatgatgctttatgcggatgccaaagtaaataaatctggaagaagcagccatgttctttcattcacccttggcaagcgaatagaaaagaacgattaagaaatttttaacctataataataaaacttttcactgtacactaagcataatagctcactggaaaaagccaatatttaaaatatgtatgtatatatatttgtctaataaagattacaacattttcaggcaactggacaaatagagacatttacagaagcattaccattgtggtgaaaggtgcgtgtgtgtgtgtatgtgtgtgtttatttacacggatgaggggaatataaagggaaaaattatgctaaaacaaaagaaaaagcaattttaaaatcatatttttctattaaagtccagaaagtctcccagtttcacacagttttattcacaattttttttttttttgagacgaagtctcgcttttgtccccaggctgtagtgcaaaggcgcgatcttggctcactgcaacctctgcctcccagattcaagcgattctcctgcctcagcctcccgagtagctgggattacaggtgcctgccaccacacccggctaatttttgtactttttgtagagacgaggtttcaccatgttggccaggctggtcgcaaactcctgacctcaggtgatccgcccgcctcggcctcccaaagtgctgggattacaagtgtgagccaccaaggctggcctcacaacttttgtcagtaaaccaaattactgtacagttaccaggactaagtcaaaggactttatattgcaatagcagataaatttatattgcaatagcagataaatacagtattccaatagtttacaatttttaaatacattgtttcacgtggctgctagaataaattttttaccactatacatcgttaacattaaaaaattatattagctaacctgactttttggggggcaattttggattacgtaatcacaaggtacaataaaacagtgaccccaacatccagttctgattccagttaaaaatttagactaaagatatcacaatccgtaagaaaagaaagaatatggatggtataaatgatgaattataacaaagtgcagtaatgaaaacaatgtgcaaacaatgctggagatcataaattacaatgggaaaatatggcaaaggaaattctggaaacccataataaaatcaagtttcaataactggctagttatgtttcattctaccttaaatctggaaagcaatagaaattccctaaaaatgcaacagcaagttgtctttatacaattctttgcattgtaatttttttctttttttctttttttttttttttttgatttgtttgttttgagacagggtctcactctgtagcccagtctggagtgcagtggcacaatcatggctcactgcagcctcaacctccagggctcaggtgatcctcctacctcagcctcctgggtagctgggactacaggcacgtgccaccatgctcagctaattttttgtattttttgtagagatggggtttccccatgttgcccaggctggtctcaaactcctgggctcaagtgagctgcctgccttggcttctcaaagtgttgagatcacaggtgtgagccactgcacacagcctaatttgtttatttaagcagaattgagcaaacgtctccattcagctcccatgtgctttattgaaaattatgtcaacttcagtatattaaaaagctacataaaataaccaggtggcaagaagacatcctaagtggcccctacactatgcgggcccagcctaggtctcctttgctcctttaccaaattccctttgtcttgccacaggccccaggacctccaagcaacttcctctccttcatcagcagttgccagcagtcatcctctgggctctgccagcaagttggcagcagggtaggattcacaccccttggcttctacctcacagttaccaccaaaggcctttccaatttaaaaaagcaattttagaaattgaaccagaggaataaccaccatgtacaaatcaaaaagcatagaggggcttataatgagaagttgtgctcctctgtcctaccttaactccctctgaaatccaggctccctatgatcaatccccttgacctttcagttctctgggtagatttcttttcttttcttttctttctttctttctttttttttttttgagacagagtcttgctgttgcccaggttggagtgcagtggtgggatctcagctcactgcaacctcctcctcctgggttcaaatgattttcctgcctcagcctcccgagtagctgggattacaggtgcccacccttacgcctagctaatttttgtatttttagtagagacaaggttttaccatattggccaggctggtctggaactcctgacctaaccgcccacctcagcctcccaaaagtgctaggattacggacatgagccaccatgcctggtctgggtagattttttttcttttgagatggagtctcgttcttgtcgcccaggctgaagtgtagtggtgtggtctccactcactgcaacctccgcctcccacgttcaagtgattcttctgcctcagcctccagagtagctgggacttacaggcgtgcaccaccatgcctggctaatttttgtattattagtggagatggggtttcaccatgttggccagctggtctcgaactcctgacctcagatgatccacccgccttggccttcccaagtgctgggattacaggcataagccaccatgcccagcctgggtagctttcttatactgctctttcttgttttatcaactttcatttaagccctgtgatggcaaatgagagccaagctcacttaaccattttcccacctccatttttgagtcctagtcttttttgttttgttttgttctgttttgttttattttgttttttttttgttgttgttttaagatggagtcttgctctgtcacccaggctagagtgcagtggtgtgatctcagctcactgcaacctccacctcctgggttcaagcgattttccacctcagcctcctgagtagctgggattacaggcgctcaccactgcgaccggctaatttttgtatttttagtagagatgaggtttcaccatcttggccaggctggtctcaaactcctgacctcgtgatacacccgcctcggcctcccaaagtgctgagattacaggtgtgggccaccgcacctggctgagtccaagttttatttccctataatttaaaaattatatcattccatgctttgtctgtaggctgattctaaaagttgaaaaccaatgtcattatttttatttttattttttttgacacggaattttgctcttgtggcccaggctggagtgcaatggcatggttttggctcactgcaacctctgcctcctgggttcaagtgattctcctgcctcagcctcctgagtagctgggattacaggtgcctgccaccacgcctagctaatttttgtatttttagtacagatgggctttcaccatgttggtcaggctggtctcgaactcctgatctcaggtgatccacatgccttggcctcccaaagtgttgggattataggcataagccactgttcctggcccaatgtcattatttacattattacgacaatgtaaatatttttctctataccacctagtcctttgctaataaggcattcttttttttctttttttttttttttttgagacagagtctcgctctgtcgcctaggctggagtgcagtggcacaatcttggctcactgcaacctccacgtctcaggtttgagcaattcacttgcctcagcctcccaagtagcgaggattacaggtgcctaccacaatgcctggctaatttttgtatttttaatagagacgaggttttgccatgttgtccaggctggtcttgaactcccgacctcaggtgatccatccaccttggccctccaaagtgctgggattacaggcatgagccaccgcacctggccttttttttctttctttctttttttttttttttttttgagatagggtcttgttgtgtcgtccaggctggagtgtagttgcatgaacatggctcactgcagtatctgtctcctgggcttaatcctcccacctcagcctctggagtagctgggatcatgggtgcacatcaccatgcctggctaatttttgtattttgtaaagatggggtttcctcatgttgcccgggctggtctagaattcctgggctcaagcatcctcctgcctcagcctctcaatgtgttgggattacaggcatgaaccaccattcccagccaacaggccctcctacacaactttttgtttttagtggcgtttctaattgcctttcatttttatccctgacattctttggcttaatcatagccttatgtttttctgtcttaaacaaattatctaatgcatgagtcattgtcttgccctactgaccctctggggagtgctccattctcctgctaggatttggattgcttaccgcacagcctgctgtacaaatgtcaccttgagtcagagtaattctcattgctttccctgaacctcttgttttctgaacccaaataaataaaaatgtctggccaggcgcggtggctcacatctgtaatcccagcactttgggaggccagggcaggtggatcacttgccttgagaccagcttggccaacatggcaaaaccccatccctactaaaaacacaaaaattagccaggtgtggtggcaggcgcctgtaatcccagctacttgggaggctgaggcaggagaatcgcttgaacgcgggaagcggaggttgcagtgaggtgagattgcaccactgcactccagcctgggcaacagagtgagactctgtctcaaaaacacaaaacaacagaaaaatttctagcccagtgcagtggctcacggctgtaatcccagcactctgggaggccaaggttggcgggaggatcgcttgagctcagttcaagactagcttgggtcatatagcaagaccctgtccctaattaaaaatatatattattaaaaagaaaaaaatttgtttccttatttttgatagcacacttttttttttttttttttttcctgagcagagtctcactctgacacccaggctggagtgcagtggtgtgatcttggctcattgcagcctctgcctccctgtttcaagtgattctcatgcctcagcctcctgtgtggctgggactacaggcatgcgccactatgcccgcctaagtattgtatttttagtagggacgaggttttgccatgttggccaggatggtctcgaaatgctgacctcaaatgttccatccgtctttgccttccaaagtgctaggattacaggcataagccatttcgtgtctggccaatagcacacgcttttaaaaaatacctgccaagaaagggtaccctgagtccttacatgactgaaaatgtatttattctgactttacttgactgtttggctgcacatagacttctaggttgaaaatcattttttcttaaacttttagatttattcttccataatcttctagcactaaatgttgtagcggaaaaatctgacaccaatctaattcttgttttatagattgtctgttttatctaaaagtttcttttattcttaatgtttggaaattttatagtgatgtatgtaggagtgagtctttttccatttgtccacctggcttataatgtttatcaactgaccccttgctccccccacccctcatagagtgcaggggctttaatttattcactgctaaattccctgtatctggcacacatcaggttctcaatagtcatttgctgagtgaatgaatttattctgctagaatttaaagtcccgtgactcgcatcagctcagaaaatttttcttttattcttgtcttttttttttgagacagggtctcaatctgtgattcaggctggagagcggtggtgtaatcacagctcactgcagccttgaactcctgggcacaagtgatcacagctcactgcagccttgaactcctgggcacaagtgatcttcctgtcatagcctcctgagtagctaggactacaggtgcacgccactatgcctggttaatttttaaaatttttgtagagacatggtcttgttatgttggtaaggttgggaattttttcttcttcttttgtgagagtctcactgtcacccaggctggagtgcagtggtgtgatcttggcacactgcaacctctgcctcctgagttcaagcaattctcgtgcctcagccacctgagtagctgggattacaggtgtgcatcaccacacctggctaatttttgtatttttagtagagatggggttttgccatgttggccaggctggtctcaaactcctgacctcaggtgatccacccgcctcggcctcccaaagtgctgggattacaggcatgagccatcacgcctagcctagttttacagattttgtagtttcttgtttttggtctataacctgctgcctacttttcttgcttccttgcctatatatatattcatttattttttaattcctttgctgagaataaaaattggatactttagctgggcttgtccttcagtttttttgtttttgtttttgtttttttttgagacggagtctcgctctgtctcccaggctggagtgcagtggcgcaatctcggctcactgcaagctctgtctcccgggttcatgccattctcctgcctcagcctcccgagtagctgggactacaggcgtctgccaccacgcccgcctaattttttgttatttttagtagagacggggtttcaccgtgttagccaggatggtctcgatctcctgacttcgtgatccgccccactcggcctcccaaagtgctgggattacaggcgtgatccaccgcacctggcctcagttttttgtttgttttttttttttaaacaggcaagttcttgctgtgtcacccaggctggggtggagtggctcgatcatagttcactgcagcctcaaactcctgtactcaagtgattctcctgcctcagcctcccaagtagctgggactataggcactcatcaccaagcctggttaatttttttttttttttttggtagtagagacaaggtctcatactgtggcccaggctggtcttgaactcctggcttcaagctattctccccactcggcttcccaaagtactgggattacaggcataagtcaccttgcctggcctttcacttttattttaggtaaactgcttttaaaataccctcttagaaaccatcttccttgctacagaagagagaaagcaccccgtggcttttcctcaaaggaagatcactgtgggggctgggcgcggtggctcatgcctgttatcccagcattttgggaggccgaagcgagcggatcacctgaggtcaggagtttgagaccatcctggccaacacagtgaaacctcatctctactaaaactaccaaaattagtcgggtgtgatggcacgtgcctgtagtcccaactacgcgggaggctgaggcaggagaatcgcttgaacctgggaggcagaggttgtattgaggtgagatcacaccactgcactccagcctggcaacagggtgagactccatctcaaaaaaataaaataaaataaccgagtatgcacaattcaactgtaatagatactatcaatttaccctccaaagtgaccataccaatttatacccccaccagccttgctaaaagtattctaagatattaattttatggttaataaaatatacactgagacttctgaaaaaacttcaaattcaactcatgtgtacccacaggttccttaataacaccataataatctggtgcatcattagggtctactggttcaaggaaaggctgggccatcttatgggcctataatgaaaaagtaggcattcttattgtcagtgaaaacactaattccatttaagattcccagttgagtcactacatcaatgaacccaaaagtcagttttaaatgcgatacatgaaatactttatattaggtgatttctgctctagtaataagttacctaagatgagcttcctctgcaataatggtactcaaagcttggtcggaagaccttggtgtggtgaaggggtgggttgcccctccacacctgtgggtgtttctcgttaagtggaacgagagacttggaaaagaaaaagacacagagacaaagtacagacaaagaaataagggggcccagggtacctgcgttcagcatatggaggatgctgccggcctctgagttcccttcatatttattgatcattcttgggtgtttctcggagagggggatgtgtcagggtcataggataatagtggagagaaggtcagcagataaacacatgaacaaaggtctctgcatcatagacaaggtaaagaattaagtgctgtgctttagatacacatacacataaacatctcaatgccttacaaagcagtatggctgcccgcgtgtcccacctccagccctaaggcggtttttccctatctcagtagatggaacatacaatcgggttttataccgagacattccattgcccagggacgggcaggagacagatgccttcctcttgtctcaactgcaaagaggcattccttcctcttatactaatcctcctcagcacagaccctttaagggtgtcaggctgggggacggtcaggtctttcccttcccacgaggccatatttcagactatcacatggggagaaaccttggacaatacctggctttcctaggcagaggtccctgcggccttccgcagtgtttgtgtccctgggcacttgacattagggagtggtgatgactcttaaggagcatgctgccttcaagcatctgtttaacaaagcacatcttgcacagcccttaattcatttaaccctgagttgacacagcacatgtctcagagagcacggggttgggggtaaggttataaattaacagcatctcaaggcagaagaacttttcttagtacagaacaaaatggagtctcctatgtctacttctttctacacagacacagcaacaatctgatctctctttcttttccccacagtgtggggggtggaacacaagcttagaagtcacaaaatcagtattctgggccctacatgatgagctgtcactgagtgatgctggcattgcaactgcttctgtaacaggtgggatgggttcaaagtgtggaatcattaccacagctgattaatgatgaggtggcagagatgtgatgttagataacattcaaccacacattgagactacgattccctttttagtttcttcaattcttgtgattatgataaaaatagaagaaagtttcaatccaatgcactatatccttttatttccccccattgttttgagacagggtctcgctctgtcatccaggctggagtggagtggcacgatcatagctcactgtagcctcctgtgctcaagtgatcctctcacctcagcctcccaagtagctggataaacaagtgtgtgccaacatgcccagctaattttttatttttattttttgtagagatggggtctcactttgttgcccagattggtctctaactaattgactcaagtgatcctcctgccttggcctcccaaagtgctgggattataggtgtgagcaaccacactggccttctgtgtcttcaatacacctgtatcacttgctaatcctgcaaaccatacctatcctggttttcttttctttcctttttttttttttttttgagacagagtctcacactgtcacccgagctggagtgccatggctcgatcttggctcactgcaacctctgcttcctgtgttcaagcgattctcctgcctcagcctccctagtagctgggattacaggctcacgccaccacacccgactagttttttgtatttttagtagagacggggtttcaccatgttggccagtctggtctcaaactcctgacctcatgatttgcccacctcagcccccacaaagtgctgggattacaggtgtgagcccccgtacccagccacctttctgtctttcataaggaaaataataactataatctaatcatactgtttctcaatccatgggagtgagaggaagtttctttaaaaataaaatgtataaagaagtgagtcacgttagattatctgagtgttagataagctgaggtggtgtggggatatggtaaagctcatgacactggtatgtgaaggactgaagtttgtcaagcccttcactagactagctgagagtcagtaaataatcactctaagattggaaacttgaaatcctaacattggaaacttgaaatcctagaaatgcttccaaaattatgccagctgatttcattttcaaatgctgcacacagaggggctctcatctgtaaggaacggagcaccctcttcaactcctcatcatccttctctgttagtggtgtgagcactgtcatgacatcctctgttgactggcactgtggacagacatactcatcaatgagctctgcctcactctgcaagatgccaatgcagcacccatggtaccaattctgacaccgatcatggccaataaaaaatctgcaagatccgaaatggaaatgtgagttcaaaacagatgggatgatgttacttataataaagcatgcacctgaaaatttgctaaaccctgggatataaaatagttttagtattgtggttttaatactttcaagatcgacattccagtacattaatttagtatttttgatgttaagaacaagcagtaaaaaaatttataagaacactgtaattttggagaaccaatttaaagataaatatgaaacattcaattgattttaaagctgaaaacaagtcacaaatctttcaactagtactgtaccatgtgggagttcaaaatcctataaggtaataacagagtctcaaagcttatacccaaattagtgtttttctaacctataataaagcaccatttcaaacactgataaagtccaaacaagtcaagctagtttaatctcattaatttctatgttacatattgaagaatcaaatctaccattaaaccacattttccccaatgtgtctcaaacattcactatgaagcaagataaattttgaagggtaggtaaaaagggaaaaagagaaaaaaaaatgaaaaggaatttgtaatgtaagtgtataacaaatgtagaaaaaatctgctttttattttaaagtaaataagtaaccagtcagagcaatttggcttcctaaattattaaatgtgatgctcttattagaactcactgtgactgcaggtgttctgcagatacagtacaattcctcactgctgccctcttgtgcccatttacaatcattacagatgtacacatccattttcttagcctccttttctgcgatgccaacacattctccataatagcagttagtacaaagatcacagccaatatagaacctagaagtattcacaacgaaaatgacaatgtaattgtcgttttgagctgcatggtacttaaatctgtcttccctgccttgcttcatttttttacaggataacttcctgctatgagtcagctaaacattcctgaatccaaccattctacccctggcaaactccagtatctgatgctctatcacatgtgcaaacaaagtcactcacatgggtttcaacaagtacactgcttagtgaaatatgggtctttaaaaacatactggaatttgaaaaaataaaccacacactgatggtaatgtcttcctctgaatgaatgtgtgcaaaactgtaacaggcacaaaaaccaaagccaaagaatcaaagacttacacctgtcaaacctattccacagaagccatttcaatatcagggctatttcttagataggtttaaaaatgtatctcacaatttaaatttgaaaacaaagcaaagcgcaaacaccaagtagaagttacactacaaggaccatgcaggtcagccaggtgtagaagataaacggtcaaaatatgctaagaagaagaaaactaagaaaggtacatagagcaattcaatctctaccaggttttctgaataaacattggaatttaatcgaattaaaaataatttctcataatggaatatggcatgggccactttttcagttaatataatgtttgtgacaatgtgggcagtggcctggctagttaacgggtagggaacgtggaaggagctgcttcagttcaacatcggggacatggtatggggaaggatgcaaagatagttatccagaatctgtctacactgcttggcagggtctacactgcttggcaaggcggagctgtgtaagtgtgtgattgtggagtgcacagtggcctctgtaataaaagacgtaatgacaaaagaaaaagtaaatgtaacaaacgcttatacagtgtgtctacaagtgttgataggcacagtgtaggaacatcatgtcaaagtcatagtgagaattaccatgaatcacagggaagcaggctggctttgccgataccattggcactcctagctctaccaaggcatttcttggtagattcacctagaggaatggaagtcgtcctcaagcttcaaattgacctgcttcatgaatgtgaaggaataatacatggctatgtagtttatcctgttaccactaacttttttcttttgtctcgctgtataacccaggctgcagggcaggggcaggatcacggccccctgcagcctggacctcccaggctcacatgatcctcccacctcagcctcccgagtagctgggactacagatgtgcaccaccaggcccggctttttttttttttttttttttttgacggagccttgctctgtctcccaggctggagtacagtggcatgatctcggctcactgcaacctctgtctcctggcttcaagcaattctcttgcctcagcttcccaagtagctgggattacaggtgtgtgccaccacatctggctaatttttgcatttttggttgtgccacgttggccaggctggtctcaaactcctgacttcaggcgatccacctgccttggcctcccaaagtcctgagattacaggtgtgagccacagggcccagcctcttttcatattttttaaaaaaagttttaatgagcagtgaggacgaccagaggtcactttcgtcaccatcttggttttggtcggcttctttactgcatcttgttttttctttttttttttttttgagactgggtctcactctgtcacccaggttagagtgcagtggcacaatctcggctcagtgtaccctgcacctcccaggctcaagtgatcctcccacctcagcctcccaagtacctaggaccacaggcacgtgccaccaagctcagctaattttttgtatttttgttagagacagggtttcaccatgttggccaggctagccttgaactcctgacctcaggtgacccatctcagcctcccaaagtgctgggattacaagcgtgagtctctgtgtctggccaacatactattgtctcaatatgcattttgccatactttttaagtgcatctcttctgctatcctgtagtacaacttactcttggaaatgatcaaagcaaactatattaccctagggacaaacccattgtgattggcatccacgaacaaatttggtgtaaagaaatcatatctatgaccaagagggtttctttcttatttggagataagagtctcactttgtcaccctgcctggactgcagtgacataaacacggcttgctatagccttgacctgccaggctcaagtgatcctcctgcctcaaccccttcaaatagctacaggtgctcaccaccatgcccagctacttttttttttgtagagatggagtcttgctgtgttgcccaggtaacttacctcctgagctcaagtgatctgcctgcctttgcctcccaaagtgctgggatgacagttatgagccacttgtacccagccataagaatatttcttaaaatctgacttaaaatttttttaaaaaattcttttagagatagggtttcaccatgttggctaggctggtctcgaactcctgacctcaggtggtctgcccaccttggcctcccaaagtgcttggattacaagtgtgagccactgtgcccagccaaaatctgacacatttataaatttctacaataattttaaataccaaaaatattcccaaaacgtttcatcatgattatttttcttcctaaatcttatagtctctcagaaaaataacttagcccacgtttcctttaaagagtttttaatttttttaatgaagggccgaattaattttatttttccttctttgaaaaaattcatccagcacactggctcacacctgtaatcccagcagtttgggaggccgagggcggaagatcacttgcgtccaggagctcaagagcagcctggccacatggtgaaaccccatctctactaaaaatacaaaaatgagccaggtgtggtggcgcatgcctgtagtgccaactacttggaaggctgaggttggaggctcctttaagcctgagaggtgaagacttcagtgagctgtgatggcaccactgtgctgcaatgtagatgacaaagtgagaccctgtcttaaaacaaaacaaaacaaaacttttttttggagacagggcctcacttgatcgccccggctagagtacagtggtgctatcatggctcactgcagggtcgacctcctggggtcaagcagtcccctggcctcagcctcgccaagtagctgagactacaggtgtgcatcacaacacccagcaaattcctttttgtagaaacagggttttgccatgttgcccaggctggtctcaaaatcctggcctcaagtgatccacccacctcagccttttagaatgctgggattacaggctgtgagccacaactctcttggcctataaatgataatttaagtgaatctctgaagctacagttttttgtttcgagatggagtctcgctctgtcgtgcagtggcatgatctcggctcactgcaacctccgccttctgggttcaagtgattctcctccctcagcctcccaggcagctgggattacaggtgcctgccaccatgcctggctaatttttgcatttttagtacagacggggtttcgccctgttagccaggctggtctcgaactcctgacctcaagtgatcgtttcacctcagcctcccaaagtgctgggattataggcatgagccattgcgcccagcctctgaagctatagttttatagattctaaagcagagacttcatatagatgtctatgaaaagccaaaaacaaacaaaaaacccacaggaaaacctgattccccacgccaaaatttcaaggatttgcctaaaggtaaggtccatctgtacctgaaataagtttgctgtgcctctttttctgcagggtaacccagccctatgcaccaatcattacatgactacctcaggaagcttttaaatatatcacaaatattttaccaaataaacctgaatggccctggtttaatgaatctgcttctctgtctatagactatctagtctcataaagtcaaaagagaagcaatgtgacaaattattcaacagcccttctctatttatagagagagactgaacttcttctttggttagaaagaaaaccttgagtttcatttcctagttcatatatttttataacatcgtgggacggattttgggagaaccaagatggtatagcgggtgcacactttgatcctccctctcccttcaagaacatacaagtgagagtaaaatataaaaaagagaaattgaaaagacatagtcatgcttaaataagttacaacaatctcaatggaacagacacaaaactgtgagcaggactaaaactgcaggccttctagactccagatgcagaaggaggaagtggtggctgaacactaacagtaagagtttctcgggggtaagggaggctaacatgctgtgtgtgaggcagtgataggctccctgctggaagttaagggttgactgggctacactgggcttcaggagagaagaaaacaacactcctctcactcaaaataagcttgcaaaattcaaatgtttgaaaatgaaaatgtgtaatatgaaaaaaagacaaccagggcccatacggtggctcatgcctataatcccagcactttgggaagtcgaggaaggaggatcacttgcttgagcccgggagtttgagaccagcctgggcaacatggcaaaaccttgtctctacaaaaaaacaatgacaacaacaataacaacaaaaaacaccccaaaattagccagagatggtggcatggcacgcgcctgtagtcccagatacttgggaacctgaggcggaaggacttactgatctgggtagggggaggctgcgatggggtgtgattgcaccgctgcactccagcctaggaaaaagaataaggccctgcttctcaaaaagcaaaaaaaaaaaaaaaaaagccaataaaatcaatggtctaatctgaattcactccaaatgaaattatagagcaatttgacaggccaggcccagtggctcacacctgcaatcccagcactttgagaggctgaggagggaggatcacttgaggtcaggagttcaagaccagcttggctaacatggtgaaaccccgtctctactaaaaatacaaaaattggctgggtgtggtggtgggcacctgtaatcccagctacttgggaaactgaggcatgaaaaccacttgaacccaggaggcggaggttgcagtgagccgagatcatgccactgcattccagcctgggtgacagagcaagacactctctcgaggaaaaaaaaaaaaaagaaaaggaaaacaactcaagggttggataacattgccagtataaccataattcaaaacaagcagcagaatttggaggataatttgtttcattctcaggaaaatgtgaaactctgaaactgctttttgagtgcagggtatttccggggcttttcctaaagtcttaacccttggctctgaccccttatttgaagtttggagagcagaaccgaggattgtattactacagttgtggacacaggagaggggttagtctccccccgctccaggagtaagggatgctgggctgctcgaacacaggccttgttagaactcccttcaaacaggatcccagagatgtggggagaaggtaactggccttaagaatgattgcgctacagctttcgaaaactataatgcctttcaaatatggcttattgcttggatctcaatatctcccacgtatcttgggtggaatattttgccgaagatctttctgtcaatcatttacaatcatgtgctgcaaaatgaagtttgggtcaacagtagaccacatatatgatggtggttctgtaagcgtataatggagctatccctatataggtataccatttttatcttttttttttttttttttttttttttgagatggagtctcgctctgttgtccaggctggagtgcagtggtatgatcccagctcattgcaacctccacctcccaggttcaagtgattctcctacctcagcctcctgagtagctgggattatagacacgcgtcaccacactcagctaatttttgtatttttagtagagatggggtttcatcatgttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaatcacctagtgacacatttctcaagctcctcacgtggcaagcaatgcatgactgcatatgaaagctcttaaatagagattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataacgatagctccatccctaaatgaggtgaatcttggactctcttccattttattttattttatttttttgagatggagtttctctcttgttgcccaggctgaagtgcaatgttgcgatctcggctcactgcaacctctgcctcccaggttcaagtgattctcctgctttggcctcctgagtagctgggattgcaggtatgcaccaccacacctggctaattttgtatttttagtagagacggagtttcaccatgttggtcaggctggtctcgaacttctgacctcagtgatccccccacctcggcctcccaaagttctgggattatgggtgtgagccaccacacccggccccccttcaattttaaagccatcactatgcaccctatgtctatgccaagcactaaaataagatgaagcaccttcttggagtttacatgctggtaattatgccagacagtaataaaataggtaagaacggctgtgggggaagtcagctgggttctagttacagtcgcatttcaggaaatgatttaacatgctgactttaacaacctaagcctcttctccatgtgtgcacacagggtagatctctgaacacaggtgaccctagaagtgctgtaacttctaggggaatggctgtgttgagtcaaggcaggatgacagttcagcctcctcccaggctagtgcaaagggctcttcactcggattaaaaccttctctcccagaccgaattgccaactcccaacacccctcctacagaaaatttggagtcctcgcttattccctggcagcccctacctaatagggtggtgaattaattatcaaacatgcgacagtttagcgaaaatggcaacactttggaataagtgactgtaatgtgcatcctggcgcccattttgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccaccccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtgacataaataaaggtgtcataaagacagggcggggctcacgcttagaaggggcacgagcgtctcggagctgccagaatgtcttctgctcagtgcccggcactagtgtgtgtcatgtcccggctgcgtttctggggcccatggcccctccttatgtggcaactattgtggctactagtcaaggaggctcagcctctggagtgggtcaaggacccgctccagctcacctctaatcccctggggccgcctgagtcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaaggctccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcaatgatgatgctctaagtcgttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttaccatatgtaggagagttggctgttcacatgattattcagtcctttagttttgtccagaactcatttttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggcgggcggatcatgaggtcaggagatcaagaccatcctggctaacatggtgaaaccccatctctactaaaaatacagaaaaaaattagtcaggcatggtggtgggtgcctggagtcccagctactcgggaggctgaggcaggagaatggcgtgaacctgggaggcagagcttgcagtgagccgagattgcaccactgcactccagcctgggcgacagagcaagactccatctcaaaaaaaaaaaaaaaaaaaaaatgataggagggaagaaagagaataggcataaaaagggaggtatatataattaagtactaaaagataatgcagaccattggtgctagaatttgccagaatctgtgatccttgaggtgtggagatgctacatgggtaagctaaaactttacttgggtcttaaagagtagctataatttgttaaatagaagaaaaatgggagtacagtctaggcaaacgcatggctacaggtatggttggaatttagtagaccaatgtggctacaaagaattaggtgagggagcaatgaagatacgattctgtaaaaccttgattatcagctataggagtttgaaagttacacagtgaggtatggaaagccattgaaagtttccaagcaagagagattacatgatcaaaacaggaagattattttattttgttttttgcattatgtgcaagtgtagacatgcagaggattgttttagaatccatatgtaaagtgtccaaaaggaaaagcttaattcagggagacaaaatagaaaggtctagcaaaatctaggagtgaagtgtgaaggggccaaatcagatcagttgtaataggagtggaaagaaaaagcctaggatgtttcaacagagggcactgggccaaagctttggtgttacctggcatagggtttctttcttctcatttgttgataatgataagcttttgcccatatttctgtggaattatttaccattttggtactgatttgtagaagtctgtttagacacataagtgcttttagataaaatacttacattcaaagtaattaactggcatcatctgtccaagagatgggatggataagaagttaagcttccaggagatgcctcatcatttgtgccagtgaccccgcataatttcttgatgaattgtgcaaactgggaagctgatagctctggaaatgagaaagcaggtgttattttctgtttctgaatatccccaacaaggttgcaatgattcttttacttatcgtgttcattgttttcctacctattcaaggatataaactgtgtttcttcacagaaatttccaaggaaactatatttcttacattgatggaaatgtatggaaagcatacagttggactgagaaactgtgagtatattctctccaaatatgacaaaaagctaactgcattgtaagatccttcttggtccagaattttgaggtcggtacctctgaggaaagatatttctcctccatgccccaaatcaaccactgttgattgcaattgtatggtcattttaaaattaaatttggtaggctctctttaaaataagaggcaatttaaatttattttttatcatacaaatagtacatggttatattcctttttgttctcttttttgttttttttttcagagacagggtcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtattttttgtagagacagggtcttcctatgctgcttaggctggtcttgaactcctgggctcaagtgatcctcccaccttggcctcttaaagtgttcatattacaggcatgagccaccacccgcagcccatgattccatttttaatatataaaaatgcaataacagatataacaaaaactctccttgtgccctactccctcatccctgaagtaatgctactctgcatttagtatacatgcttccagacttttcctcatttacctacatacatatttacataaagcaaaatagatttgttttgtggttttaaaattttttcttcgcataaagggtaacatcttgcaacttgattctttcacttcatgatatgccttagatttctttccttcccagtacttagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctggaaatggaattcttggggtgaagactatgtagatataaaattttaattgccttcaaaaattttgtgccaacttactctattgtcagcagaatatgacagcattcatttcccaacaccttttcaccgctgggtattctccaacattttgctgaagttatggatgaataaaagggattccatctaaatgtgaatttttctgattactcatgaatttaatttagtatctttatatgtttattgaacatttgtgtttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattatttcaatgtatatagacaagccacgatgagttctaaattaaaaataaacatatgctaggcgcggtggctcacgcctttaatcccagcaccttgggaggtaggcggatcacctgaggtcaggagtttgagaccagcctggccgatagggcgaaaccccatctctactaaaaatacaaaaagtagccaggcgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagcgattctcctgcctcagcctcctgggtagctggaattacaggtgccctccatcacacccagctaatttttatatttttagtagagacagggtttcaccatgttggccaggctggtctcaaactcatgaccgtgggtgattcacccaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggcatgctagcaatgatcttttgtaaggatgtttacatgggtatctgcttcataattattaaactgaatattttggccaggtgaggtggctcatgtctgcagtcacagcactttgggaagcagacacaggaggatcacttgagccaggagtttgagaccagtctgggaacagagtgagaccctgtctcaaaaattaaattaaattaaatataaacaacatttatgttatgtgcactttatgcacattatagttctccaatttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataatagaatttggtgggaagaaacccactcttcaaggggtgtgcttgagtgtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtaaaatgaataaggggttcaaattagataatctctcagatttctttgagcaataaaattctgcaattctgtaagtttgtatagggtctcagcccatctctaacactagctacctcctgtgcattttcagtttttaagttatatagacaaaatacagacaaaaacatttcacatggtaagaaaatctgagcagtgactgacacccatatgaaccttgttttataagggttcacatatcattctttttctattcagtctacaaccaatagatctaatctaatttatggtctatttttaaatagcccattaagttaagaatgggttttgcatttttaaagggactgtgaaagaaaaagaaaagaaacaaagaaatatgcgagagatcatatgtggcccataaaacctaaaatatttactgtctgaccttcaccaaaaaaaatttcaaaaagttggtttagtaggatgaaaggaactaaagttaacttcagatggttgcctaaaggagaagaaaatggagaccacctgcattcatttgaacatcattaatccagaattttttggtaatttaatcggaattaaattaacatttaaatattaaaaatagctgaattatatcaataatattatcaagaatattaagctaccaagagaatagactggtattaaggatttcatttcaggaattgttatattaaaacagatgtttaaaatgatggttaactgatagagctagaaatgtttacactaagaagcacatcagaaatgcccctaactcttcactaattacaaaataacgatcgccccagccctgttaccagaaagggatccctgtatttctgtctgtttagagacaagaagatactatgttcattgctatgaaagcttgattcttaccctttgtccatagaggtctgtatgtcattaatccttattaagctcattagtgatgctcttttgcaaacagattctttcaaatatagaaggcttaaggaaagtgggtgtaaagaccctcaggtggatgccaaagtgctacagagaccatgaaataataaaactacatttcctttaaaatagttattttccttctactcactcccccagctattcatttattttacaaatatttgagtttgctttatttccatgtgtcagttttaaacatggtgggcaatgcagatgagcaagacctagtccatgctttcagggagtttatgctcagaagaaatgggataaaaaataactacattaagaagaagaaatggatgtgggcactaggagggataaattgtttctcgaacatagaagaggaaaaaatgccttcaatttggacccaggaggatgttactagaacaatgccatttgaataggactttgaagggccattgtgtaacatcagacagacatcttggggaaaatactctaaacttgcaaaaggaaaatgggagggcaaaacacaggaaagtattcaaggaatgccatgagtacccgtagagtacaagaagggagagtaggaaaatggagccagatcttctagagctttgaatgccaagctgaggagccaacatggggaaccgtgttaccacagcagcgctgtaaggtagatctgcatcacagtcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactggagatggagatatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagtgcagtggtgcgatctcggctcactgcaaggtccgcctcctgggttcatgccattctcctgcctcagcctcctgagcagctaggactacaggcacgtgccactaggcccggctaattttttattttttttgtagagacagggtttcaccgtgttagccaggatggtctcgatatcctgacctcaggatctgccagcctcggcctccgaaagtgctggattacaggcctgagccaccgcacccggcccgactattttttttaatattagaaattgtgtatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggcagggttaggggctctggaatgttcaaatacaagtccaaacgtttagagttgagatgaaaaataggtattcagtattattctaaactcttgctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctctttgctattcttgaaatatgattaaaattttaccagtagaaagctactaaaattatacagcaaatcctttttgtctctagcaaggattattgtgagaattattacacagatcttagtgaatcatcagagagcagtggttctcaggtggtgtgattttgcactcaggtggcatttggtaatgtccggagacagttttggttgacaaaactgtgagtgtgctcctggcatctggtgggcaaaggccagatatgctgctaaacatccttcaaggtataagacaaacccccatggcaaagagttatatagtccaaaatgttgatggcactgaagttgtgaaatcctgttctagagaaataaagatcacttaacacaggtatttactgaacattcactgttttgtatctaatgcaccacgtgtgcagtgttaaagtataaatcataagccagtatcttccacagtcagatttccttagtgcatagagaaaggattgaggttatgttccatcctatataaattagaatcatggcaaatgataaatgttctgaaataattttttttttctttggcttgtgtcttttttttttagaaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcatgtcttaagatccattcatttttctcaaatggggaagctaaggtacaaagaggccaagagacttatgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaattagctgggcgtggtggtgcagttttttgctccctggaggactttgtgttaagcttccttccttgcagctaaatgttgcagacatctaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcaaaacctcatctctactaaaaatacaaaaattagcaggtcatggtggcgggcacctgtgatcctagctatcgggaggctgaggcacgagaatggcttgaacccgggaggtggaagttgcagtgagccgagattgtgccactaccctccaacctcccctccaggctggtctcgaactcctgtgacctcaggtgatccgcccacctcagcctcccaaagtgctggggttacaggtgtgagccaccatgcctggccaagatggtgtttatgttaagctattgtgcaaaaaaaaacttttgtaaagaaaatatatcactgtatcttaattccatatactttcctgactactcttctaccataattgcaaaaattctatgatttctctgtataacatacccatcaaatcagagtgggtatattcagtggcctgaaggggactcaaggtgaagattctcctctacatctgactttagaaaagactttccacctgccttgtggttcagaaatctagtttcacacagttcatttcaagttagagggaggcattcaggatgtgtctggactagagcagcagtttctgcacatgctcccctctgtcctcattaatttgctgatgcataacttaggaaaagtacactaaaggtctgtttttcttttgccctcacaccagagaacaggctcattaggtccctccaccaagaggtttaggtagcatcaatacaaatgttttaaactcaccatctttactaagcactttataccactgggagtccctcataaaaatctggtggccgggagcggtggctcatgcctgtaattccagcactttgctgaggtgggtggatcacctgaggtcaggagttcaagaccagcctgaccaacatggtgaaacctgtctctactaaaaatacaaaaattaggtgggcatggtgacaggcaactgtaatcctaggtactcaggaggctgaggcaggagaatcacttgaaaccaggaggcggaggttgcagagagccgagatggcaccattgcactccagcctgagggacagagtgagactctgtctcaaataataataataatataataataataatcatcatcatcatctagccagcttcactacaattatgtaggcaacaccaggaaaacactggaatcacagttgataaaaattaatgaattcactcaaaaacattcagagtgtcatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggctccgttggagtcaaatcttcctggtaaacaaagctacactgcagtcatatttggcatatgtgacatataggcccactgcatttccttccaaaggcaagatgccaagggaaggtgccagtaattttatgaccaaaatgacaccattttgtggtgtttgtaagttgaaacaatatatttccctgcattacacaagtttataaaaaacaaacaaaaaaagaggccccagctgtggttgatcgatgatgaattgaatagagcctaaccttccaggcttctcacttgcacaggcccttccaaggtcctgggagggcccctggaaatttttgtagtcataatttttttaatgtttttactagataaggctcaggccccacaaaatcctgaaatcatccctgggttccaatagttacaacccagtaaatctcttgaatgaagcctctatgttattgacaaatactgactggccaagttagcagggttaaaaggtctgtctattttgaatctgaaatccatctcaaagacaggccaagagcttattagtggacttaactggattctgctggcccaagcgcagtaaagtcaaacaaccatatcgaggttttgcattggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcacatattggcttgtctatggcacatcgatatcatgccaagaatgtaagcactaagagagaataagaggaaaatccaggctttatccctattgaattatttatcccactattagaatattagtgaggtaggtgtggccacactgtgatggcaaattgagcttcggtcacaaacatgccttactgttccccccagtctactgacatcagcttcctttacatagcggtagatgcacaaaagtttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcatcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgtagatgaggaagttgaaactcagagacgctaggtaatttgctaaggttcacatggctaataagtggcagaaccacttacaagctttgcaaataattttcaatgcagctcttagttcccctgtaataggagctgaatgatgacaatttggctttgtgtgcattgtgtcttactttctaacttgaataggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaacgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaaaaaggaaaaaggctcaccatttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatagtgggtgagggtctaggtcatctgcttatttctttgactaccttcttccatggaaccagttttccctgacagccttgggattctagcatagatcattttggagtttgtcatttaaatttattttcacggcctgctttggacattttttcagctagagctgttaggatttcagtacatttaagacagtgatgacatgctccagtcctttcatctctgtctcctcagttaatagaaaggaaacatagctcatctatctggacctgtacagaagaatttggagggaaaaaaaaaaacaggcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctgaaaaaaagcttgccacattttacttccataaagataccaaaaaggcgatggactgggagtcagtgcaccttagtttaatgtataaaatgaaggacttgaaccagaaatggaaatggtcatctactgtgaatctaaaaacactcgaggctgggcgcgctggctcatgcctgtaatcccagcaatttaggaggccaagacaggcagatcgcttgagcccctggagttcaagttcagcctgggcaacaaagtgagaccccaatctctacaaaaagacttttaaaaagtggaaacataaatataaataaataaaaacattcatatcatttggtttgtggaaaagagttgctgtagagtcctcaaacttgagccgttgagccagttctcactcagtctctccatggcccaggcacaaccttagtcaagaaaagaatgccttagaacaggaggaaaagaggataatatcgaatggccctatattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgccaagttgtttggctacatactgccttacagtcattatttttggtgtttagaaaaaaatagaaacagggtctcactttgttacccaggctggtctcaaactcctgggctcaagctctccttctgctttggcctcccaaagtgctgagattacaggcttgagatgctgtgcccagcctacattcatttttaatagctgggaggaaagtgggcagaggaagatatagaatgaaggggtagccgactttgtacagagcccaccagtggtcttacaagttttcatgccaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaagaggagggggatcacaaggcaggacaagctgtgtggctcccagcctcgccactgactcactctgatcttggtcaagggagagtgaatcttcactcctcttttttccatctgccagcatgtttggtcttctggcacctggtgttctatacagtacaacatgcttctttgtgttacattgagacttgatccacgtaccatcaacgcagtattataaagtgtacaattcagtggtggttagtatattctcaaggttgtatagcaaacaatcaccattatctaaccccagaacattttcatcatcccaaaaagaaacatggtacccattagccatcactccccagtgctgtcttcccgcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatgtggttgtttctactttattttggcttttatgaataatgctgctatggacatgcatgtactactttttgcgtggacatgtttttaattctagggtgcatccctagcagaattgctagatcgtatggcaactcttatgtttaactttttgaggacctgtcaggctgatttccacagtggctgctccattttacacttccatctgcaatgtttgagggtttcaatttctccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatataacttctttgaagaaatatttattcacatcctctgcccatttaaaaaattgatttgtctttttattgaattataggaatttctttatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgaaatttactcccatgtttttgtgtaagagtcttatcgttttggctcttacatttaggtatttgacatattttgcatcaattcttataatcgtgtgagatgtagggggtccaccttcattattttgcacatagatgttcaggtgacgccattgcactcaagcctgggcaacagagtgagactccaatggagacggggtttcagcacgtttatccgtttatcaggctgctctcgaactcctaacctcagatgatccacctgcttcagcctcccaaaatgctgggattacaggcatgagctaccatgcccagccaataaatgaaaactttttcactcaaaaaaacaacaattgtagtgaaaccatagatcagtttggagaatcatgctattattatctgcttcatgtttacagaatactccgttgaatttggtttgccagattttgtcaagcatttttccatctacattcgtaagaaatactggtctgtaattttttgtgtgtgatgtctttagtttggataccaggttaatatcaccctcatagaataagttaggaaatgttctctcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctatttatgtctctaagaacaatagtaatgtcccctctcatttctagttttaataatttggtcttctgtatttttgcagtgcagtggctcatacctgtcatcctagcactttgggaggctgcggtgggaggattgcttgaccccaggagttcaaggccagccagggcaacatactgagagcttatctctacaaaaaaaatttaaaagttagctgaacgtggtggcacatgcctgtagtcacagctactcaggtggctaaggcaggaggatcacttgagcccgggagatcggtgctgcagtgagccatgattgttccactgcactccagcctgggaaacagagtgaaaacctgtcttgaaaaatgaacagtaagaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttagccgagtgtggtggtgcgcacctgtagtctcagctacatcttaattttataacgttgtagttcagattaattccaactttgtttcaatggtatacaaaaactttgcttctctaaagctccactctcaccccctcctttatactgttattgtcacacattacatctttatataccttatgttcatcaactagatttataattattgcattatgtaagtatctttttcttttttttttttctttattttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccagccagtgctttttatttctttgtgcagattcacgttagtactccttatagggcaggtcttctagcaacaaagtctctcagtttttatttatctagaatatcttaatttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgcagtggtgcaaccactcacaacgttgcagcctccacctcccaggcttaagcaatgctgtcacctcagcctcctgggtagctgagactacaggcatgcaccaccatgcccagttttttttgtttttgttttttttaatttttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgactcttaacgagcatgctgccttcaagcatctgtttaacaaagcacatcttgcaccgcccttaatccattcaaccctgagtggacacagcacatgtttcagagagcactgggttgggggtaaggtcatagatcaacagcatcccaaggcagaagaatttttcttagtacagaacaaaatggagtcttctatgtctacttctttctacacagacacagcaacaatctgatttctgtatctttttcccacatttcccccttttctattcaacaaaaccgccattgtcatcatggcccgttctcaatgagctgttgggtacacctcccagatggggtggcggccgggcagaggcgctcctcacatcccagacgggcatgcccagttagttttaaattttttgtagagacagggttttactctattgccagtgctggtatccaactcctggcttcaagcaattcttgagcctcaagcctcccaaggtactgggagtacaggtgtgagcaaccatgtccagcacctgcattgtttttgaagacaaattagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccatcatttcttcaaatattctttctccttttttctgtttttcttctcctgggacgctcattatgtgtatgttagtaagcttgatgatgtgttccacaaacaggtctctgagattccattcactttcattcatttttatttctgttcctcagagtcaacaatctcaattaaccttcaagttccccattctgtcttcagcctgctgtaatgtgccattgagaacctctaataatttttccatttcagttaccatacttttcaactctagaatttctatttgactcctttttatggtttctatctctttattgatattctctatttgatgagacattgctttcatactttcctttagttctctagtctacagaactgaatcgtttctcttatctctttgaacatattttaaatagctgaattaaatccttctctaggccaggcatggtcgctcgtgcctataatcccagcactttgggaggctgagactgaggttgaggctgaggccaggagttcaagaccaccctgggtaacttcgcaagaccccacctataaaaaataaaaaaatctttgtctagtaagtctaacatctggtccttctcagggacaatttctgcttatttctcccccaaccacgtgtttgggccatactttgtttccttgcatctttcataaatgtttgttaaaaattgaatattttaaataatataatgtagcaattctgaaaatcagatccatgctgccagggtttggtgttactcctgcttgtgttagtagttgctatttatttagtgacttttctgaacttcttctgtaaagtctcgcattatatgtcatgtgttcccactaaagtccctcctcggttagcttaccgatcaggtaatgattaaatgaagatttacttaaattcttggaactgataagtctcctggtttttgccaaggggctctgtgtacatgttggggcataccttcagcactcagctagacaatttacagccatgccttagctttcacttcttgcttgtgcagaacctcaaggtgtcagccagggatgagagtttatgaacttagtaggtctttcctgaccatgctgacagtctgccctatgcatgcgcgtgacattccaaattgccaggaatatgtcttatggacttctagtttcccaagcatatatcagagtgtttcaaattcctgtggacatcttattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctggttggggatgtgggctgttttccaaggcgactactgagctagagggtgaggaatggtctaaggcaagttaacacaaatctcactgttcttacagaaatttttcttgaataaatgctccttgggttgctgcaagactttggttacatttctagagttctgaaaaagtttattgtggtcaattttttttttttttttttttttttttttttttttgctattttttttggtatttgttgcttttatgaagggatgaatttttggatgtctcttttttttttttttttttttttgagacagagtctcactctgttgtccaggctggagtgtagtggcataatctcatctcactgcaagctccacctcccgggttcacacaattctcctgcctcagcctcccgagtagctgggactacaggcgcctgccaccacgcccagctaatttttgtatatttagtacagacggggtttcgctttgttagccaggatggtctcgatcccctgacctcgtgatccgcctgcctcagcctcccaaagtgctaggattacaggtgtgagccactgcgcccagcctgcatgtctttattccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgttctccagcctgggcaacacagtgagtgagaatgtgtctcttaaaaaaaaaaaaaaagtctcattgaccatagactaataaactatttaatcatgggaaatgattaggggaaagacataaaaagagaaactgtaatccacttttttttgctctgttgcccaggctggagtagagtggcttgatcttggctcactgcaacctccgcctcctgggttcaagcaattctcctgcctcagcctctgaaacagctggaattacaggcaagcactgccgtgccctgctaatgagaaattgtaattctcatagaggtcctcccagaggagtagaagaaggttgaaaggcacttctgtatttagtcttctcacaattaaggctgggcccagtggctcacaccagcactttgggaggccaaggcaggcggatcacttgagatcaggagttcaagaccagcctggcaaacatggtgaaactcccatctctactaaaaacacaaaaaatagccaggcgtggtggtgcgtgcctatagtcccagctatttgggagactgaggaaggaggattacctgagcttgggaagaggacgttgcagtgagccaagatcacgccactgcactccagcctggtcaatggagcaagaccctgtttgggtggggaggggaggggagtggaggggagaggagaaaggaaagaaaggaaaggaaagaaaatagaaagaaggaagggggagggaaggaaggaaggaaaaagagagagaaaaagaatgaagaacaaaaatgaaaattttttaaaaacctaaggttaaaataaaccctttttcttcatacagattaaacacgagttcaaattacagctttgctgcttaatagcttggtgacctaggacaagttatctaacctctctgtgcctcagtttcctcatttaaaaatagggcaataataatatctaccacataaggtatttgctgatcacaaatacctggcaacccagtagatactcagtgtaataattattatttttataatttctgcctaagtacaaagataattcttgggttaacctaaaggtagattttcttttatttcttcctgtttcttttatttttcttgttcaccttaaagaattaaaaagaaaatcgattccagcattttggaataaaaatttgcatcaaaatcaatttattcattttattgacatatgaacaaaatgtcatttgtttattcaataaacatttgttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaaaaaaaaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggtagatcacctgaggtcaagagttcaaaaccagcctgaccaacatggtaaaaccccgactctactaaaaatacaaaaattagctgggcgtggtggtgggtgcctgtaatcccagctactcggaaggctgaggcagaacaggagaatcacttgaacctgggaggcggaggttgcagtgagccaagatcgagccattgcactccagcctgggcaacaagagcgagactccatctcaaaaaaaaaaaaaaaaaaaaaatagatgaacaagttgaattatgatgagcaacttgaattatggaggatgctagaaatactgtttcctccacagtcagggcttcctaccaacatagtcacttttagggtttttgacctgaaaagttctgtggcatattttttctttgctatccactttttttttccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattctattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaattaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaggtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaattttttttttgtttttgaaatggaatctcactctgtcgcccaggctgcagtgcagcggcatgacctaggctcactgcaacctccacctcccaggttcaagtggttctcctgcctcagccttccgagtagctgggattacaggcgcatgccaccacacctggctaatttttgtatttttagtagagacaaggtttcgccatgttggccagggtggtttcgaactcctgacctcaagtgatccgcctgcctcagcctcccaaagtgctaggattacagataagatccaccttgcctggcctcactcagtagaattttttttgagattatgctaccatccatgttgttgcacctatcactacagctggccctccatatctgcaggttcctcatccatagattcaacgaaccatggatggagaatatttggaaaaaataaaatatataaaacaacaatacaacaataaaaacagtagaaaatttaaaatacagtataattatgtacataccatttacactgtattaggtacttagagtatacctgaggctgtatacaaacattatgtcatttcataaaaaagacctcagcatctgtggactttggtaactgcagggggtcctggagccaatcccctgcagacaccgagggacaactgttcactcctttttattgctgagtagtattccggttgtgtggaaatgccatctctactaaaaatgcacaaattaggcaggtgtggtggcacatgcctgtaatcccagctactcaggaggctgaggcacgagaagtgcttgaacttgagaggtggaggttgcaatgagccgagattgcaccactgcactctaacctgggcgacagagtgggactctgtctaaaaaaaaaagtaagaaataaaaatgttttctgaagagcagaagtttttaattttgaccagctttaagttagcatttttttcttaaatggcttgtgattttttgtttcttacctaagaaatctttaagaacctgttgtctaatccagcgtctaaaagattttctcctatgtcttctcccagaaatgatacacatttaggtctatgatccattttgagtcaatttgcatatgtgatgtatcttttttattttttatttttttgtagaaatgaggtctcagtatgttccccaggctggtctcggactcctggtctcaagtgatcctcctgcctcacctcccagagtgctgagattacaggcatgagacaccgtgcctggccttctttgcaggatatatatatagatatatatatatataaatcagccaggtgtggtggcacacgcctgtagtcccagctactagggaacctgagtcaggaggatcacttgaacccaggaagtggaggttgcagtgagccaagatggcaccactgcactccagcttgggtgacagagcaagaccctgtctaaaatatatatatatttatatatatgtacgtgtatatatgtatatgtatgcctgcagggccctattgtgagtttgttacacaatttactgcaacttcaattgtgccaccagcccccacaatatggcaagctaaatagagactcagttatgctagggctggttgagggaattttgcaagattagcatggaaagggcccttcatttagcactctgctccgttcatttttgtcaggtcactttcttatcttcaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaactgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagacttgtcagtatactttaaaacaatcctgggaacagttctagattgaaggagactaaagaatcatgtactaagtgtaatgtctgatgtttgattggattctgaattttttaagccatgttatgattaggacaattgtgaaaatgtgtatacggaccgcatagtagacaatgataatatgaagttccattgagtgatgatagtcctctggttatgtcggagaatgccttggttcttaggggctgcacactgaagtcttcaatggtgaagggtcattatgtctgcaactgactctcaaatggttttgtccagaaaatgtatagacatacacacacggaaagcaaatgtggcaaagtattagcaactactgattccagatgaaagttatacaggtgttcattataccatttgaaaatgtttcccagccattctaaggcttaaaggaaaaaaagaaaatgtttaaaataaaaagttgggggcagaaaaagaataccaaaaattttgggctcatgcctgtaatcccagcactttgggaggccaaagagagagggttgcttgtgcccaggagttcgagaccagcctggacaacatggtgaaaccccatttctacaaaatatacaaaaattagccaggtgtggtggcacacacctgtagttctaggtactcaggaggctgaggtgggaggatcacttgagcacaggagacagaggctgcagtgagccaagattgcaccactgcactcagcctgtgtaacagagcgagacccggcctcaaaataaacaaaagaaacacctttgtggcagaggtaaggttgctatacaacaaaatgctgggttacggttccgggtccattccatatgaagatcagaggcttccactggaccccaaggaatactactagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactcactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatcttccatgacattggcattttttaagagtcaaagatagctgtcttgtaaattgtcccacaatccggatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaaaaaaaaaaaaattagctgggcatggtggtgcaagcctatactcccagctactcaggaggctgaatttggaggatcccttgagcccaggggggttgaggctgcattgaggtataattttgccactgtatttcagcctgggtgacaaaataaaaataaaaataaaaaataataattttccccttggtaattaataaataatctgtgggttgttactttgagttcagtgaagatcctgttctcaaatgttttttcacccaaatgtgcatcaatgataatccttgtctgaatgaatttgtattacactgacggttgcaaagtgacacttttaaaaattctgtcattccttctacatttactagctggcattatttcattgaagaagaactcctcctctttctttttcaatatcactcttcgtggattcttctttatattaaatatgtggtaacttattgttgttattcttttgaatgctcaaattgtccagatttgaccaatgcagtctttgttattttttaactccgcaatccaggttaaactatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattccagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcacgagtccagccccaagggaggtggaacagccccacacacagcaggggcctgagaagttagcgggaaacgccgtctacaccaagccttcgttcacccaagagcataaggcagcagtctctgtgctgaaacccttctccaagggcgcgccttctacctccagccctgcaaaagccctaccacaggtgagagacagatcgaaagacttaacccacgctatttccattttagaaagtgcaaaggctagagttacaaatacgaagacgtctaaaccaatcgtacatgccagaaaaaaataccgctttcacaaaactcgctcccacgtgacccacagaacaaccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctctttcagaacattttatagagaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccagctacttggaaggctgaggtgggaggatcacctgagcccagggaggtcgagtctagtgaacggtgattgcaccacggtacccaagcctgggtgacagagtgagaccctctttcaaaaaaataaaaaagaacctgtcagctactcacctggaatactggggttttgaatagttagctctcattctggttttttttttgtgtgtttttttttttagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttattgcagtgtatatttcaggatttttaaaggatcctcgctttcagatctctgtgaattgaaaccaagtgaatcccactagactattttaagaagtcgatataatagcaaaatttctcccacccaaaactatgtcaacaattggatgtactcatcaagtcacccttactctgccactaatttatttccttgttgctgaaatgatgagagaggtataatctccaccctcacggagttgtcatcaccctggagaggaaggagagagccaaaagacatacgtattgtcttgtagacttattagatttacacagtatcatcctccagtgtgtaaggcattgtctaaataggtccagttaaagcactacagagtagccatcttttacaaaaatttttggccacatttttaagttcactggtgaggaggaacgtctcatactctagccctcctgagcctataccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgctaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctggtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggcttaagggatcctcctgcctcagcttcctgagtggctgggactacaggcaggcagctaatttaaaaaatgtgttcgtagagacaaggtcttgctatgttgcccaggctggttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaaaaaaaaaccaataaaaatacaaacagaaagtacaatataacaactgtcaacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtacatgagacttataatgaataaaaggaatcaatacagatttggagatggtggttgttgtcatagataatcttaattgcgttttcttctaaaacagatatgttgtcaccgaaggtcattacaagaagatgaagaaggattctcaaggtaaatattagtctggtgattttttttttcttctcttttgagatggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagggcacttgtctccttcaaggctgatggaaggtaggatatgtgagtccttcctcttaagtggcaggaaacagtattttctcttttatttctttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaagaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtcagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatctgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatgaatgaaaattgtgattccgatgaagcctgccagagaaacaaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacattaaaaaggcaagagaagccctaagcagagtgagcaccagactccacaggttaagggctcagtcacacagaaccatccgcatgtcagaccccaggtgcaaggccaagcatcacctatgcatctgaccaactggctgtaaattggaggtccccacaactccctcctcaggtttgaacatttgctagaacagctcatggaacccaggaaaacagttttcttactagtgctgatttattacaaaggatattttaaaggacacaaatgatgaagccagttgaagagatacacagggtgaggtttggaagggtccttgtggagttggggtgcaccactctcctggaacatggatgtgttcgccaacccggaagctctccaagtcctgtcttttaaggagttttctggaggctttatcacgtaggcatgattgagctccagctctactccccacgccagaggatggggaatggggctgacagcacaacgcttccaaccataggtctttttggtgaccagtccccaaataaggagcccaccaagagtcacctcatgagaacaaaggacgcttctatcacccagaaaattccaagggatttaggagctctgtgtcaggaaccaggtttaaggaccaaatgttagaacaaaagatgtgcaaccataaaaaacagcgagatcatgtcttttgcaggaacacagatggagctagaggccattatcctcagcaaactaagacaggaacagaaaaccaaatactgtatgttcttttaagtgggagcaaaatgatgagaactcataaacaacagacactgggccctacctgagggtggagggtgggaggagggagaggagcagaaaaaactattgggtactaggcttggtacctgggtgatgaaataatctgtacaacaaacccccatgacacaagtttagctatataacgaacgtgcatatgtaccccctaacctaaaaggaaagtttaaaaaggaaaaaacacctaggagaaaagaaaaatgataaattaacaaaggacaatgctcttagcaccgccatcattcaggaatttccaagggttttaggagctttgtgttaggaactggggtcagagaccaaatatatatttcttcttatgttacactaccccagataggaaaacagaaattactctagatatttcaaacaaaaaagggttgtatataggcaattagtgcttatcactggaggtgctagaggtggtgaaggttgtggggatggggttgcaccactggctttcaggctactttaccacagctgatttccagaggatggaagaagtcaggaaacttgggaaaccgctgctgaggtccttgcagccccacggtccccaggctggtgactggtgggggagtatggagtccagctgaccaccagagcctgcacacctgctgctatgggggaggaaaggatgacttctacctcctttccacattccaaattccacgtgactacattttattggcagcaccccgctggcaagtgagccttgatgtgtgcttcctgggcttctggcacctgcacagaaaggggtgaaatgagtgtcacgagcagccaccactctgcatcacacctccacatccaggtgtgctggagagccccacttacacttggagtgtcctggtgccctacccacttttggtaggtgtttgggtgtctgaggctttgcaaaagaagaaggtggggagtctatggtggagtcacatggtggagacctagctaagtcagaggcctggagaggtgtcactggctgggcagcaggtaacacacaatcatcctgagctgattggagaaacacctgggattgattcagagttttttctggaatgttttcactggaatgaaagctgagcggtctgcaggccatatagtattggagaaaacttagccctcattgaaaaaggctgccagagaaaaggtatccacagggaaattcaggagttttgtttgtttttttttctttttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattacaggcacccaccaccatgcccggccaatttttttttttttttctaaaaacagtttcaccatgttggccaggctagtcttgaactcctgacctcaagtgatccgctcaccttggcctcccaaagtgctgggattacaggcatgagtcactgtgccccgccaggaaattcagtttctgaaaatacacctgtggatctctagcctagaaaaagggacctcttttattctttttttttttttttccagagacgggcctcactttgttgcccaggctggttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggccccgcgcctggggatgggaggcaggactgcaccttcacagggacgcttccaccctaccccggaggtcagggcctctcgcccagctctggctctgaggtcctggagggagggagatgctgttgcgactcagaagattgggggagggccacccccattcgagaagagtgaaaatcctgagcctgaagaagtggaaccggttggagccgaggctttagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactggcttacgacatgagagctcaatatgctccttatttaacgcactgttgtatcaggtccctgtgggagccactggctctatagcctaataaaggagcgggtgcacgcactggattggtgagctaccgccactgcaacgcgtcctaatcaaccatcctaaacggcggctggaacaaggttctcgcaggcctgtgcttgggcttgaacgctggtccagccgctgcgctctgtggctccctgtaggcctgcggatcggccagggggctccgttccttttgggcggaggctgaagaagcagcggctgcaccagagaaggccctctgggtgaaggtgggagcgcacggggcccgcggaaccacctaaggcgacttcagacgtgggctcggaactggcagcctttcgtttctgcttcattccaaggccagagcaagccacgtgggcaaacccaaagccaggggacaggaaagtatcctccacccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagcacatagtgctaagtatttggcttgtaatctgtagagactctgccatttggagctgggatctgtccccagagctgtcagacaccaaatcccgtatctactgccacccaaagggacctccagaagaaaggggttatacagggtcaaacaccaaggcaggttagtgaaatttctctagaggccatttaaagctggagtctcaccacctgaactgccctcagaggaaggctgtctagggcacaaacctagtcaggggtccacatggacttaaggacaatttttttttttttttttttttgagacagtctcattctgtcatcaaggctcgagtgcagtggtgtgaactcagctcactgcaagtctcaacctcctgggctcaggtgatcctcccacctcagcctcccgagtagcgggaaccacaggctcgtgccatgatgcccaattaattttcttttaaattttttgtagagatgaggtctccccgtgttgctcagtctaatcttgaactcctggactcaaatgatcctcctgcctctgctcctcaaagtcctgggactacaggtgtgagccaatgcacctggcctcttatgaataattttaaaaacaatgaggttcaccgtcagagcccctgctgctctaccaagtcccttggcccctctcaacagggcaaaagcaagatgagccccagatgttctgcttaatgaccacctttcccaggagactttgctctttaaaggagaaccacttagagatatgagcaaccttaaagaatgccaccagcactagtgaatgccaggcacgggccacgtgggtggagagtatactttagggcagtcactcatggtaaattatttccaccagcccccagaagtgactattcaatgtccaactatgtcaggcccaggctaataaaagtagaggcatgaggaacctagggttgttctgaagtgccttgattatggtacatgtggaagattttagagcttgttgtaaaaagtgatgacccatggccccccaggctgggtctgggattccctttgtggattacaagaggatattatgcagcagtttttaaaaatgaggcagactgggacaatctatctccaagatgcataggtgctgttaagggaacaaagcaagatttagtagggcgtgtatagtatgctactgtgcgctgtgcgttatctgtacagaactgtgaggtctgatacagtagccactagccacatatggctatttacatataaatttaggttggccacagtggctcatgcctgtaatcctagcactttgggaggccaagtgggaggatagcttgaggccaatagttcaagaacaccctgggcaacatagtgaagccccttttctacaaaaaatttatttatttatttatttttattttttttgagacgggtctcactctgtcacccaggctggagtgcagtggcgcagtctcagcttattacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttaggaggctgaggtgggaggatttcttgagcccaggaggtcaaggttgcagtgacctatgactgcaccactgcactccagcctggacaacagagtgaggccctgtctcaaaaaataaataaataggagtttgaggccatgttcacacatcactgcagtccagtctggtaaacagagcaagacgctgagtctttaacaaaaaaaaaaaaatttttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaactggtaatggcggttgccttccgggagggaaactgggagagtgcagggctgtatgcccttttgtacctcttgaatttcatatcatgcgtttgtactaggtgtttacaaattattttaaaaacatactgggaattaggaatccccatatggaatcactgcagtgggacactgattcccaaaaaattactttgcaatttgcctaaaacaaattaagctaatagctatcatgatttcatatttaatattttttcacagcttagagtttttttagctcctgttgctatctctctgctcttatgagctcacagggtgacaaagtgaattagtaagtagcaggagaacattaaaggaaaaactcctgggcaacagggcaaaacgccggctctacagaaaatacaaaacattagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagatatgagccactgcatccaactttggttcttgtttgtctgttttgttttgttttggtttgtttttttgacagagttttgctgtgccacccaggcagtgactcagcctcggctcactgcagccttgaccttctggcctcgagtgatcctcccacctcagcgccaccccccactgccctccaatatctgggactacaggtgcgcgtgaccgcacacagctaatttttaaattttttgtagagatagggtttcactatgtggctcaggctggtctccaactcctggactaagcgatctgcctgccttggccacctcccaaagtgtgagccaccatgcccacccattgaacattgaagctagactgggcaaacccttaagcctaaaccagtaacagtttttcacaagttcatagatgttactgtggttaataacacacaaattcatttaaaagcatgtgtgtccacatagtaatttttggtccttatttttatttttatttttcagttaatggatattaaagatacaactttattttgttttttttgagacagggtctcactctgtcacccaggctggagtgcagtggcatgatcagagctcattgcaacctccacctcctgggttcaagagattctcctccctcagcttcctgagtagctgggattgcaggtacatgcaaccacacctggctaatttttgtactttttgtagagatagggttttaccatgttgctcaggctggttttgaactcctgagctcaagtgatccacctgcctcggcctcccaaactgctgggattacacaagtgagccaccacacccggcctaaagatataatttctatcatgaggaggtccaagaactattctctttttctttttttaatgttagaaagggattaactgggtatgtgctgcagcaaagggaggggaaattaagcaagaagagaagggagccaggaaataaaggccccaacccaggaagcagttaagcaaagttccaggatgacccatgtgacaagtttaggggataacttgagcacatggaggacagaacttggagagggcactgtgggcctgggcgccacctgctccgccagagcactggaagagaacgagggcacgataatggcagatggcactgaaagaaaaggagagagcttgaggcacccttgggggaagcagccatcatcagagtgtattttatttttattttattatattttgagatagagtctcactctgttgcccaggctggagtgcagtggcatgatctcggctcactgcaacctccacctcccaggttcaagtgattctctgcctcagcctcccaagtagctgagactacaggggggcaccaccacacccggctaatttttgtatttttagtagagatggggtttctccatgttggccaggttggtcttgaactcccgacctcaggtgatccgcccaccttggcctcccgaagtgctgggattacaggcgtgagccaccatgcctgacctcacagcacattattaagctctgtggtgaataatatttatatagtcacaattctgtaaacactgttcattttctacaaattgtggcaaacccaaacctcaagaatggacagggctagggtgtaaaagagctaagtccttgccaggtttaccaggaaggcaacagacagtgtctaaaactatgagacagctgggcgcggtggctcacgcctgtaatcccagcactttgggaggccgaggcgggtggatcacgtgaggtcaggagtttgagatcagccttgacaacatggtgaaaccccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaaggagaaaaatatttatccctaataactaatggaccatcttacgccgtctataaaaatatcaattaagaaatcacggccgggcacagtggctcacgtctgtaatcccagcactttgggaggccgaggcgggcaaatcacttgaggtcaggagtttaagactagcctggcaaacgtggtgaaaccccatctctactgaaaatataaacaaattagccaggcatggtgacgggcacctgtaatcccagctactcgggaggctgaggcaggagaattgcttgacccaggaggtggaggttgcagtgagccgagatcacaccacttcactccagcctgggtgacagcaagactccgcctcaaaaaacaacaacaacaacaaaaaacgcggtgatacacgcctataatcccagcactttgggaggccaaggcgggcggatcacaaggtcaagagatccaagaccatcctggccaacatggtaaaaccccatctctactaaaaatacaaaaattagctgggcatggcgcgcacctgtagtcccagctacttgggcggctgaagcaggagaatcgcttgaacctgggaggtggaggttgcagcgagccgagattgtgccactgcactccagcctggcgacaaagcgagactccgtctcaaaaaaataaaaaagaaatcagaaactgttcaaattccaatctatacaagtgaaacctacacagttaaatgtcttaatagagagctaaaagcattaagttctgtcatactcaacatactgatgaaaaaaatttgaactaaaagacagcctgatctttagaaactggcagaaaaaataggggctgcatccaagaccactcacggcacgtccattcttccagcagctcccaactgctattttatgaaaagtccaaatttcccaccccaaggtcctagagtacagccagctccctaccatcaaaaacaatagctaccaaaactcagtaaaattaggcttgttatgaagagaagattgaagaaataaaggtatttatttcatcttggtatttgaatgtggaaactcccagtagggtaagaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaattctctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctttcttctacaaactatatttcagggaaaccaaatatttgatgagggaattctttgtttagaaggattttagctaataaatgcagaggaataacaagatttaggaggggggagaaatcaccattttgtgacttctaataaaataatgggtctaggcaacagttttcaatggatgctaaaacgattaggtgaaaagttgatggagaattttaattcaggggaattaggctgataccatctgaaaccatttggcatcattaaaaatgtgacaacctggtggctgccagggaggaaggggagagggtgggggaagaacagaagttatagtttatgggcacaaagttttggttttacaagatgaaaatagttacagaaatgaatggtggtgatggttgcagaatattatgactgactatacacttaaaaatgtttaagatagagctgggtgcagtgttgcacacctgtagtcccagttatgcaggaggctgaggtaggagaaccacttgagcccatgagttcgagaccagtctgagtaacatatagagacctcatctcacaaaaacatcactaccacaaaacaaaacaaaacaaattgttaagatgctaaattttaacttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaaaactagccggacgtggtggctcacgcctatagtcccagctactcgggaggctaaggcaggagaatcacttgaacccaggaggctggggttgcagtgagccgagactgcaccactgcactccagcctggccaatagagggagactccgtctcaaaaaaaaaaaaaaaaagaaaagaaaacatagttacccagcaattccacttctaggcatatacccaaagaactcaaagcagggactcaaacagatacttggacatgaatcttcatagcaacactattcataatagacaaaaagcagaagcaactcaagagtccatcgatagatgaatggataaacaaaatgtggtatatccataaaatagaatatcattcagccataaaaggaattaagttctgatacatactacagcatagatgaaccttgaaaacattgtactaagtgaaagaggccaggcagctaaacttccaaagactaatatacaattccactgaataggcaaattcatagacagaggatagaataaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaaaaataaacttgtaaattttatattatatatactttgccacaataaaaatttttttaaaaatgtctaagtgtgacaaccgaacttctgtgttaggataggaagaatacttatgaagtattcttgcccctgaaatgaaccaaaatctaatcaagtctctagaataaacaaccagttcacaggaaatccacagatagccaagcaagttagatggcaccataataaagtaatcaaccaaatccagaatgtggaataagcagttaaaaaaaaaaaaaaagggggggggaggccaggcgaggtggctcacactatggtctcagcactttgggaggccaaggtgggcagatgcttgagcccaggagtttgagaccagattgggcaacatggtgaaaatccatctctataaaaagtacaaaaaaatttgctaggtgtgatggtatgcacctgtggtcccagctacctgggaggctgaagtcagacaatcgcttgactccaggaggcagaggttacagtgagccaagattgtgccactgcacgagaccctgtctccaaaaaaaaaaaggaaaaaaaaaggcatagagaaagaacaactgctgtagaataaaagactaaagaggcaaaacaacaaaatgcactgtgcgaactctgatccagatgcaaacaaagcagatgtagaaaagatgtagaaaggatactttttttttctcttttttttttttttttgagatggagtctcgccctgtcgcccaggctggggtgcaatggcgcaatctcggctcactgcaacctccgcctcctgggttcaagagaatctcctgtctcagcctcccgagtagctgggattacaggcatgcaccaccaagcctggctaattttttttgcatatttttagtagagacagggtttcaccatgttggccaggctggtctccaactcctgacctcaggtgatccaccagccttggcttcccaaagtgctgggattacaggtgtaagccaccacactcagccaggatacatttgatacaactggagaaattagaataaggactaggtgctagatattaaagaattattattaattttggagatgttataatagcatgaagattttatatatatatatatgccttatcagttggaaatgaacactaaaggacatatgaataaaaggcatcatgtctgggatgggcaaaatgcttataactgttgaggcttggtgatgggtacatgggggttcgttatgttatcctctctgtctttgtatttgttttagattttccactaaaaaagttaaaaaaataaatgcactactttgagaaaaaacattctaaaatctatagcctggaaaagataactgcaaatagagttaattgccaaaggtaacagctaaaacaatgatataaaatataaagggacagtcgacttgggtatttcatctggaaagactgacgaatatgtaagtctttactatcaagtacatgcaggagaatcttcaaaacaaacagactccaaataaattctaaaatgagaaatttgtagattccatatggttaatattttacatgaaaatcggggtgtaaaaactatagtcagccctctgtatccacagattcaacccaccttgaaccaaaaatattaaaaagtaataacgcaggccggacacggtggctcacgcctataatcccagaactttgggaggccgaggcgggtggatcacctgaggtcgggagttcgagaccagcctgaccaacatggagaaaccccgtctctactaaaaatacaaaattagccgggcgtggtggtgcatgcctgtaatcccagctactcaggaggctgaggcaggagaaccacttgaacccgggaggcggaggttgtggttagccgagatcgcgccattgcactccagcctaggcaacaagagtgaaactccgtctcaaaaaataaataaataagtaaataaataaaaataataacgcaacagtaaaaaaaaaaaatacaaataatacagtctaactatatagcatttacatgctagtagacataagaagtaatctagtagtgatttaaagtagacaggggggctgggcacagtggctcacgcctataagcccagcactttgggaggccaaggtgagcgaatcacctgagatcagaagttcgagaccagcctgaccaacatggtgaaaccccatctctactaaaaatacaaaaattggccaggcgtggtggtgcatgcctgtaaccccagctacttgggaggctgaggcagaagaaccacttgaacctgggaggcggaggttgcagggaggcaagatcacaccactgcactccagcctgggcaacagggcaagactctgtctcacaaaagaaacctccccagtaagtataaagagaccctaagagaggaaatggctgacagtgtaaatagagcagagcaccagaaggtatcacttcaagcatccgtctttagagacatttcacagaaacagtatcgaggctacaaaccgaataatctttaccttttgtgttctggaaaaaatgctgccacagaggtctgattttgaagtggctgccaacatcccagacagcgaaggtgttatttttatattctactgtctccacacagaaacctaaatgaaacatggggaaaacatttaattatgatttgtgctggttgaacaattcaaaataatttcaacatgcggacagtacttttaatttacaaagcagcctgctagtcaaagatctatagccttcaaagagaatgtgctggccccctcgcccattcatcaggacaggtgtctcaaaccttctctactctccaatctctagccacgcacctgccctttctctcagcaggagactatcacagtgtacttcagagcagagaagccgccgatgggaatgacttccacttccaccatacagtgtaaaagccagtctacatctttacccatgcttttcttcctccctcttggaacaacagaagaaggtaactctcttccaccaactccctccctctatgagccagatccaccctacccagactgtctggaactttttactattcctattctctcccatatctgaatatctccaatctgttcaccttggcatgcttaagccttttacatctttaaaaacaacaaaacaaacctttccttgatccccacatcttcatcgcactctcttccttcacatcttcaccctctatttgctttttttttttttaagagacagggccttgctgtgttggccaggctggagcacagaggtacaatcatagctcactgcagcctcaaactcctgtgctcaagggatcctcctgcttcagcctcccaagcagctagaactataagcatgagccaccatacctagctaaatttaaaaaattttttgtagacacagggtctcactatgttgctcagattggtctaaaactcctgaggtcaagcaacctgtccactaagctttcttcggtcctctcacgcaacagcaccttagctctgctccaccattgggtagctggttttcagtaaggtcagcagtgatcaccaggtcaataaatctaacacaggccttctcagttcttccataatttgatcttctatctgacgctactgctcactccctccttgacacccttccccagcttcccttttccttctatctctatggctgtactgtctcagtctccttagtgaactcagccacgtttaactgatcctgcaatgatgggagtcgccctggctctcactggccccatccactctcctctttctgcacccctccctaggcaatctcactcactcccacgacttcattcctatctctgtactaactctgagatttatatcccccaacctagccctctctcctgagcttcaggctcataatctaacagctttggcaaatgtcttcaaggccccaaaacaaggtgatcagtcaaaaatggaatttaaggtccctacccccaacctcctcctctgctagttatcccatcattgacttcgttccacaagctgatagcctgagaggtgccctggaaacatccgatgctcgcacccctagaaccctactaccacaccttatcaattcaaccccttcaacaactaatagtcaccctaacccaacagaccatcatttctagcctcaattcctgaaaccatataactaatttcacctcagccactctccctctctccatccggtcaccatcttctaaacaaagcaatagcttaaaaacacatagtgtggtcacgtcatttctctacacatttatgtttgattggaatattttcaaacttaaaaaagaaagaataatcgccccaaaaaataaaattaaaaattaaaaaaaaaagaaagaataagccgagcacagtagctcacacctgtaaccccagcactttgggaggctgaggtgggcagattgctttgagctcaggagtttgagaccagcctgggcaacatggtgaaaccctgtctctacaaaaaaacacaaagattagccaggcattggtgccgtgtgcctatagtcccagctacttgggaggctgagacaggagaactgcttgaagcaaacattgcagtgagctgagatcacaccaccgcaccccagcctggatgacagaataacatccaagaaagaaaagaaagaaaagaggaagagagagacagagagagagagacagagatgggaggggaggggaggggaggaaggaaaggacagaaaagggagggagggagggagggagggaggaagggaggaagggaggaagggaggaaaggaaaagaaggaaagatgtccccttagcggcttcccacacccaaatcccaaacatgactgtcaagacccaagcaagctgggtctgctcaccttccaaacctcaattctagtcatgccttattttagtgagagacactcgttacattgcaacaatctaaattcttgctaaataaataaatacaatgccattccaatcctataatgatggtaggggcaggggcaggaaacttagcaaaattatctaaaatttaacctggagaaataaacaagtaagcataaccaggaaatctctgaaaatgagtaatgaattatttttaaggatatgccaagccctagtaacacttgaatagagttcaaatataaatgcaacaggtacttgcccaaaaaaagacacacataccagtgagaatttagtatgtaacaaagaaggcatttcaaatcagcatggaaaaattattcaataaatgacattgaacaactgtctaccccagcaccgtccaatacatagtcactagccatttgtgactatttgtttatgtttttgttttattttgttttgtttttgagacagagtctcgctcttgtcacccaggctggagtgtatggtgcgatctcggctcactgaaacctccgcctcccggattcaagtgattctgctgcctcagcctcccaagtagctgggattacaggcgcctgccaccacgcccattttgcaattttagtagagacggggtttcaccatgttggccaggctggtctcgaactcctgacctcaggtaacccgcctgcctcagcctcccaaagtgctgagattacaggcgtgagccaccatgcccggcctatttatttattttttgagacacagtcttgctctgtaacctaggttgaagtgcaatggtgcaatatcagctcactgcaacctgtgcctcccgggctgaagtgattctcctgccttaacctcccgagtagctgggattacaggtgcatgccactactaatttttgtatttttagtagatatggggtttcaccacgttggccacgctgatctcgaactcctggtctcaagtgatcttcccacctcaacctcccaaagtgctgggattataggcataagccactgcgcctggcaacgtggctatttaaacttaaagttaaaatcaaaaatcaatcaataaataaaaataaataaaaaataaacttaaagttaaatacaattaaaagttcagttcccggctggacacagtggctcatgcctgtaatcccaacactctggggggccaaggtggacggatcacccgaggtcaggagttcgagaccagcctggccaacagggtaaaactccgtctccactaataatacaaaaattagccgggtgtggtggcgtgcacctctaatcccagcttctcaggatgctgaggcagaagaatgacttgaacccagggggcggatgttgcagtgatctgagatcgcgccactgcactccagcctgggtgacagagcaagattccatctcaaaaaacaaaaaagttcagttcctcagttgcattagccacatttcaagcacatgaacagtcacatggctattggctacgacactaaacagcacagacacagaacattttaatcactgcagaaagtgcctcctgggcagcactggcttatccatttgaaaaatttaaccaaattactaccttacacacaaccatctcataactcgaacattctcctcggtttcccactcctcaatcgatgcaatctctgcagctactgcccaagttgaaagttgatcatttggagaccaggtgcggtggctcacgcctgtaatcccagcacttagccgggcagatcatttgaggtcaggagttccagaccagcctgcccaacatggtgaaaccctgtctctaccacaaatacaaaaattagccttgcatggtggtgaacgtctgtaattccacctactcaggaggctgaggcatgagaatcgcctgaacccaggaggcggaggttgtagtgagccgagatcgcgccactgtacttcagcctggggtgacagagcgagactctatctcaaaaaaaaaaaaaaagaaagttgatcatttgagtcctgtgcctaattcaatattcagaacagaacagtagtaatgttcacatgccacctgtggggtgtatcctcagtcagaagtttggatctagaggcagttcacaaggcaaagattcagttctgtcaaaactcgctttgtaaatctcttaacaagccggtaaaacacagtgctggttcacagtaagagcagtgcagccagcttgtctatttctctagttggacatcatctcaagcagttggtttgagccagagtgaagaaaagaaatcacactccatctctaagcactgggagcgtacttggtgtagagatgagatgctgccactaaggaaggccagctggaacagaggctgactgaggaggcaccagcagattcccagctcccacctcagccttctgctgggacactagctgcgaggaatgaggggcagaactaccctccctgttttgcccattatctttttcttttttgccaagcaaatggggttaaatttgcttagcctccatgtgttcacatgtctcccttgtgaacctaagaatgtgcaagccactagaaaaggatacataacctggccaggcgcggaggctcatgcctgtaatcccagcactttgggaaaccatggcgggaggatcgcttgagcccaggagttcaagaccagcctaggcaacatggcaaaaccccgtctctactaaaaatacaaaaattagctgggcatgctggtgcacgcctgtagttccagctactcaggagggagatggaaggatcacttgagcccaggaagttgagactgcagtgagcagagatgtaccactgcactccagcctgggtgacagagtcaaaaaaaaaagaaaaggatatatataacctggtttttggcctctaaaaatgtatgctcatggagtagacaagatttttaaaaagaattattcaataacataagaagcatgtaaaaataaaacatatttctctggtgaaacagaacctaaaaaatatatataacatactaaattgtaaactggaattgccacaggtctttcattaacttacctactgtagggacggcaggcacagtctcccccagcttcaatttatacaagatggtggtttttccagctgtatccaaactcaatataagaatccgcatcttttttttcccaagtagacttttaaagagcttttcaaaaatgtttcccattgtaatttaatcgaattctgtaacatgacaagaaaagcaagccaaataattgttctctgcagagatatagaagcaacacgcagaaaatacaagtgtcaattagaaatggctcccaggaaaaattcaacaattttaggtacactttggccaatgagtagtgagtcttgtcttcaaagggaaactcaactaaacctttccatgccttaccagaaaattctattttccactgcagcatccaagagggatatgcaacatagcctcagcactgctatgacagtggcagcctttagtcatttagtacagaagtacaaggccaggtgcggtagctcacgcctgtaatcccagcactttgggaggccaaggtgggtggatcacctgaggtcatgggttcaagaccagcctggccaacatggtgaaaccccgtctctactaaaaacacaaaaattagctgggcacggtggtgcacgcctgtagtaccagctactcaggatgctaaggcataggaatcacttgaacctggggaggcagaggttgcagtaagccaggaccacgccactgcactctagtctgggcaacagagcaagactgtctcaaaaaattaattaattaattaattttttttaaaaaacaagtacagaagcaatgatacaacaaatacaactatacctcattctaaactctactgaaatgagaatttatgaaacagagaagctttttattttatgcaatataaaacaaagtctttaagacaggttaaacaacaatatcccttggaaacgtagtagttccttatggctagcagacaccttggaaataacctaagaaatttcagaggcaaagaaattcagcgttgggaagcttcactgccaagagagataacttggcagagttgaggaggcaccacagcatccagttttcgtttgagttttttgttttgttttgagacagggtctcgctctgtcacccaggctggagtgcagtggcacaatcacggctcactgcaacctcaacctccccatctcaaacaatcctcccacctcagcctctggagcagctgcgaccacaggcatacgccacctcgctcagctaatttttgtattttttgtggaaatgaggtctcactatatttcccaggctaatctcgaacccctgggctcaagtgatcttcccacctcagcctcccaaagtgctgggattacaggcgtgagctaccaggcccagccagtatccagtgttctattgctgtaactatcaccttactctcaaccagttcttagaactttttatttaagtataatttacatacagatataaacatacatgataactgtaaagttcaatacattttcatgaaccaaacacacctatgtaaccaaatcaagaaaagatgatttatcaggctgggcacagtggctcatgcctgtaatcccaacactttgggagaccaaggtgggtggatcacctgaggtcaagagttcgagaccagcctggccaaaatggtgaaaccccgtctctactaaaaatacaaaaattagctaggtgtagtggcacacacatgcagtcccagctactcagaaggctaaggcacaagaatcacttgaacctgggaggtggaggttgaagtgagccaagattgggccactgaactccagcccagggcaacagagtgagactccatctcaaaaaaaaaaaaaaaaaaaaatgattatcagaccaattctccttgtgcctcctcccagtcattactccataaaaggtaatcactatattgacttctaacagcataaatgttcaatattttatttttcagtagaaatcatggtaggttatataaagtaagtcaatagtaaagtcagactaacttacagaaatttacagtctctttgagatcagcctacttgaaatgtgagcttgacattctaagtaaagacttacaagcagtgctgggtctacacctctaactaagctcttggaagtctgtaaagatcttcagaccaggcagggtggcttacccctgtaattccagcactttgggaggctgaggcaagagggtcactttagtttttgcttactgagataacagaagacaagggaggattgctttaggccaggagtacaagaccagcctgggcaacatagcgagaccctgcctctatttttaaaaataataaaacaaaaaaaaattcaaaaagaaaaagacatacatccttgttccagagactgtgatttattttctttttaaattgctaaccaaagaaagctttactcctgggcaggggaggaggaagacacaaggaggatagccaatctcccattcattcggactctggtaaccacagagcggaggtaaccaaattccacaggcctcaccgctgaaattcaacagtggccagcagtagcttaatatcatggattacgcccaagtacacaacattcctttctaggatgagagaaagcgagcacagaatttatcctgttcacaaatgtggcgtaagtgaccaaagaatgataaatgttttaatcattcaaagaaagtccattataggtctataaaagtccagtgcattgcagcactcaaaatcttgccgggcgacaaaactagagattccttttctttgtttcgaaaaacaaatctcacagatgaggagacttttcaggaacatgctgggggagggaaggtacttcccgctcagatgccccttgaggcagctagtcccaattccccctgccaaccgcacagacacaccaccttgacctccctctcccttctctttcctcttattgctactcatgtgccccaggcgcccgtggtcctgacacccctgcgccgctggagacccctctaaggtaagatggctccgactacagggcctttttggcacgctcagtctcccagccccaagcgccaaaagtgcattagggagaaacgtcggcacgacgtcaagggcgcgaacaagcgtggtggcccaggtgagcgtgcgcggcagccaggcacgcccggctcccggggaaagacgccccttttttgccccggctgccaggccgctccttctcaacttgtgcgcccctggaagagcaaagagagggccctgcgtggaacctatgaagcctccttcggttcctcgctgctccggccctagagagggcgaagaaggaacagcggagcccaatccctttccgaaagccaccgccgccctccagtttctggcccgcagacgaagtggagatccagccaggtcttgagtgctgccgccccatccctgcagccggagactcacctgttgccactcaaggtaccgctacctacaacaccgccgactccgcggcctttaggatttcagctcagttcagctaaaccacgacaggcgtgggggcaggaacagcaaccaaccaatcacccaccgcctcctggagcttttgcaccaatgagctcgaagttttgtgagtgacgacatatctggccaatgcaaagaagagtaagggcctgggagggagggagcgccgtaggcgacgccatgaagctctggcaataccatgttcatcttcaaatcacagttaaacgaattctggcgagacacgcccacgtcccccacccccgatgccatgtgcgaccaatcagaaaagcaaaaggattgtctatttgcacggccaatcagctgggaaaatcgccgaggtttgagctaacctcggagcgtccacaccaaccgggaggggacatgtgggccgggccaagttaatagtgccatggaaggaaatttaccgcggttgagttaaacgtagacattagtttggggcggtgttccgcgtaggaaataccacacactgacactgaaattaggcataaggaagttttcctattccgcctgaggctagactgccctcccacctctacacagattttcaagttggggaaaatactggccacccgcacctcgttaagacgtcgcagaaccagtcctcgtttccgagaaatgctttctatagtcagttccctaaatgcccaacttgttagctaaaaaggttacaaacgcctgtaaatggtacataactgaaatcatcagaacaacaaacatctattaaacatatactatgtgccagaaactatatcaagaacttcagcaggcccggcgcggtagctcacgcctggaaggccaaggctttgagctaggagttcgagaccagcctgagcaacatggcaaaaccccatctctgcaaaaaaaaacaaatttaaaattagccgggcatggtagcggctgtagtcccagctactcgggaggctgaggcaggaggatcacttgagcccaggaggtagaggctgcagagagccgtgatcacgccactgcactccagcctgggtgacaaagcgagaccctgtctcaaaaaacacgaacaaaaaaagttagaagatactgctagaattgactaaataaataaataaataaataagaaaaacaatgttacctgcaggaccgtaacgcccagtgaattacaaactattatccctggccagacgtggtggctcacacctgtaattccagcacactgggaggccgaggcgagcagatcacctgaggttgggagttcgagaccagcctgaccaacatggagaaaccccatctctactaaaaatataaaattagccgggcgtggtggcacacgcctgtaatcccagctacttgggaggctgagacaggagaattgcctgaacctgagaggcagaggttgcagtgagccaacatcgtgccactgcactccagcctagacgataaagcaagaccctgtctcaaaaaaaaagaaagaaaagaaactattatccctgctgttttacagaaaaatattaagtagcctgggtctgtcccactcccacaccttaatctttttctttctttttccttttttttttttttttgagacagggtctcactgtcgcccaggctggagtgcagtggtgcgatctcggctcgctgcaacctttgcttcccaggttcaagtgatcctcctgcctcagcctcacaagtagctggcattacaggcatgtgccactgcgcctgcctaatttttgtatttttagtagagacagggtttcaccatgttggccaggctggtcttgaactcctggcttcaagtgatccacccacctcagcctcgcaaagtgctgggattacaggcatgagccaccgcgcctggccaccttaatctttttaagcaaatacagaatggaaactgccctcacaggattaaggagagttacaagccaggctttaggcagcattatatatagttagctgttatccagggtgcacaagtgtactttgacccacttccctgcagctgctaactcactgaacatcactccacgtgctagaccacctcctacctgtttctccatggttcttaccatgagtaagaatttctgacgctagactcataagatcgttttgcccaagaacgggttgtttttcagatcctgaattctgacgtccccaaccaaggaacccactcagcacaagaatgaggtttcttggtctccctgtctcatgacttcgcccttcacttcttgaccaatcatcgatccccacactgcagcccctgtccagaggacttaaaaaccctgccccccaaacctctcagggaggtggatttgaggcttcttcccatctcctcattcagatgccctgtgattattaaactctttctttgctgcagccaggtgtctctgtatgctgactcactgtgcattgagcaaacaaaactattaaattacagtactacttactcttctaattacagtgcttatatgtatgagggttaatataaatacatatgactccttaaaaattaaagtatgttttttctgactataaaaattatacataaccgggtgcagtggctcacacctgtaatcccagcactttgggaggccgaggcgggcagatcatgaggttagatcaagaccatcatggccaacatgctgaaaccccgtctctactaaaaatacaaaaattagctgggcgtggtggtgcattcctgtaatcccagctacttgggaggctgaggcaggagaattgcttgaacccgggaggcggaggttgcagtgagccgagatagagccactgcactgggtgcagagcctgggtgacagagtgagactctgtctcaaacaacaacaacaacaacaaaaaactcatgctagtttaattttcatttatttgatgacttgctatttttccaaatgtttactagtatttttatttcatctattagaaatgatatattcatgtcctactgacttccaagggaaagatagaaagttgttttgccaggaactatgaaggttgtttgaatggagtcatcataacctaaaaaaaaggtgaaataacgaaggtgagatttttacttaccattgtttgttcctacagaaggaatgctggagctgataattatgagaatttatccttccatccctcatagcctaagaatattcattattttcccaatatctgcactgagcctgtaaaccaaaatgtatctgagacatgtctcaatcaatttacaagtttattttgccaaaattaaggatgcttacctgggagacaggcctgtgcctttttccaaaggtgattttgagggatttagtttggtttgtttgtttgtttttgagccagagtctcactctgttgcccagggtggagtgcagtggtacaatcttggctcgctgcaacctccacctcccaggttcaaatgattctcatgcctcagcctcccaagtagctgggattaacaggcgcgtgccaccacttctggctaatttttgtgtttttagtagagacggggtttcaccatgttagctaggttggtctccaactcctgacctcaggtgatccgcccacctcagcctcccaaagtgctgagattacaggtgtgagtcaccgcgcccggccagaaggatttaatattttatttatttatttatttatttatttatttatttttatttttgagacagagtcttgctctgtcacccaggctggagtgcggtggcacaatctcggctcactgcaacctccgcctcctgggttcaagccattctcctggctcagccgccccagtagctgggattacaggcgcacaccaccatgcccagctaatttttgttgtttttagtagagacggggtttcaccatgttggccaggctcgtctcgaactcctgaccttatgatccacctgcctcggcctcccaaagtgctgggattacaggcgtgagccacggtgcccagcaaggatttaatatttaaaatggaaaagcaggctggaagggaaagaaggagagtatggtcacattactgaattcacatgttgcaagagacaaggagcaagtaggggaatagtcaattatgtattactctcgtgcttaccataagataaggtggacatagagtagttagctgcagtcagtcctgcttaggaatgaaaggaaaggcaacttcttgcatgactcagctttcagcttaattttttttcttttggcagaatgaattgggttcccaagtttttattttcctttcacaagcctctgaataaacaaagttcctgcccacatggcattcaattgctaaacaattataatcacataaatacatacacatatacgtatatgttttatatatatatatatatatatataatatatatttaatacatacgtccgggtgcagtggctcacacctgtaatcctagcactttgggaggctgagttgggtagactgcttgagccaaggagttcaagcccagcctggtcaacatggtgagaccccatctctacaaaaaatacaaaatacaaaaattagctggtcatggtggtgtgcacctgtagccccagctactcagaagactgagatgagaggactgcttgagcctggaaggcagaggttgcagtgagccaagatagtgccactgcactccagcctaggagacaaagtgagactctgtctcaaaaaacaaacaaacaaaatacattcatatagagagagaaaaagagggagaattttataatgatatgcatgaggaatgtataggggaagaggctaaaaataggccgaacttactagtgaatatattcaggaggtaggactgtgattgtttttaagtgatcgagggaaaatagtgtactgattttaaaatggaaaactcaacttattttttaaaaattaaaactctgacaagagggaggtttaattgaaatcacagtggctgctcagggaagtttataaatctcgaactgcaacgactcaataagcatgaattgcttgtgatgatattgacttaatagagttattttttccttaatagaaaacacatcttatcaatataatgttatttgtaaagcatggaaaggacaaagtgctcttgggagaagtagaaagagaatttcactctgagaaacctatttggagaaagctcctcatctctggcttagactttaaaattagttaatagtgtaattagggatagttgtagtaatagtggtattggtatggtagttagagtttaaatgtcacacagaatacccagaccaccttcccccaagtgccactaaacttattcttctaatcaaacctctgctcaagggatgtcttcttcctctcttggaaagctgtgttccttacctcagaaacagccctccataaacctgcccttaagagaatccttggccaggcacagtgattcacgcttgtaatcccagcactttgggaggccaaggcgggtggatctcttgaggtcaggagttcgagagctgtctggccatcatggtgaaaccctgtctctaccaaaaaataaacattaaaaataaaaaaattagccaggtatggtggtgcgtgcctgtaaatctcaactacttgagaggctgaagcagaattgcttgaacctgggaggcagaggttgcagtgagctgagatcgttccactgcactccagcctgggcaacagagcaagactccatctcgaaaaaaaaaaaaaagagagagagagagaatccttaagacacgccttcttggatgccctctggagaaatgtcaagagtagccaatatagtcaccccagtcggctgtggtgtgtgggcctctagtgttttaaggttctaggcaacttagcccctcccaggagatgctgatttacttttctcaaggtgcataaagtctcatcacaccaatatctgaaaaatctcttttcaaagagatgcaggcagccttccagccccatgatgttaatacacagggttaggcagcctggcaagtgcactggggcccccactgaaggatcatctggtttccatagcaacagtccttcctttccacggaggattctatcatctctcctgctcactcaggctttccagaatgaattgttttttgtgactataggtgtttgtccttgatcctgcaaagagaaaagacatattcatttaaaacaaacaccccccaccccgccccgcaactgactgcagctagaatactgcattgcatcagctggtcttcctttcatttaaaaattccatgtcctttctccattttgctccgttctctagctttatccatcattttagaaaacaggtttctctgacagaaaacaaacagatggcaactccatcatcctaaaactggctgtgacggggctctaaaattaagtgttcatggggctcccagaaagcctaggcttgcatggtatgtgtggctgacctgtgagttacgattggaggggcaagagaaggctttctatacacagatggctccccatacagtgtcacagtctctgaagtgttgccttttgaggtttgttttcttaggtcaggcactgctgtcctgtcagtattttcctaaattgccaatactcctgggaagagtaatacgttaggttactaatactgaaagaacttgggaaagagaggagggggtgcagcgggaagggaataaaaggggctctgaagaccacctttgtgtgcttcacagtgacatcttctgcaagaggggaagtgcaggtcttcatctctctctttgtctctctctgtcacacacacacacacacacacacacacacactgcaggatgccttctgacaattacaatacagtagtgaattcaccgaacaggactgttccctgaaacacctacatacaatcccgctggaagacctttgaaacagccctgcagtgactaaaaactctgtccccagtgccacttgtttaaccctacagtttccacagactaaaggtagttttcctttggttaatatgaaaacaccaaatagtcagattgctttgttaaataaagtggattacggtgaatctgttcacttctatgttttatattgccctcactccacaaatcacagaagatatttatttttcccccagttaaattctgttaccacaaccattacaaacaaatgtctatataaccaaaatgttagtcagccccattccaatggagcacattttaagtgatgtttaatgggacataatttgaacataaaattctatctgtgcactgttttcaagtctttgaatcaggcctccacctatagatgttggttacctatcagggagcaacaggtgatgctaaggatcactttgtaaaaaccaggaatcacatccctgtaactgacaggaaactgactatattcatcagggttctccagaaaaatagaactaacagaatgtgtatatacataggaggaaattttgtttaaggaattgactcgtgtgatcgtggagactttgggagcccaaaatctgatgggagaagctggcatgcaggaggcccagggaagagttacagttctagtccacaggtaacctgctagagaattccttcttgttctggatgagtttggccttttgtctattcaggctttcaagtgattggatgaggcccacctacattatggagggcaaccttctttactcaaagtctacagatttaaatgtaaatctcatccaaaaacaccctcacagaaacatccagaataatatttgatcaagtatctgggcaacatggccaagccaagttgacacagaattaaccgtcacactggatcacaagggctgtgttcagcaagaactgaccttggtcaaaccctgcccctgcccttatgccccactcttcttcattctgggtcctgctatttccattttatcatgtcttcatcttctttccccacctttcaggtacctttcctctctgaccctatccctagactcacctcctaccccccactcaaagcccttccttccttaaaaaatgatgttagtcattacactttaggatttaaattaatcattctgttagccgtcttactaactttctcactgtgaaaggaaagcatattaaaagaatttcagggatcgacgaagagctgagggaggtatttttctaggaagagaaagtgactaacagaaatcaagacaaagggggacaatcagatttttcagatgacagaaagcaggtaaactctagagatctagagaactagcaaatggtctcttcagggtgtcatcattgcagtaaatgagctctagctatttctgtctttattcttcagggtattcaagattgcagttacttaggagagacagagcatctgactgattgaacttgggttctgtattcactcctgggccagggggaggcagggtacctggtctgacagtccttccaaggctgcatgaaccagaggagctgttaccagaaaagggcagagtgaatttggggcagcaaaaacatttattgcttatcgactatcactgcaaggattactcagagggtgatgcagaatcagcacccctctatttctaagatgaccttgaatgtcagagcaaggcacaaacaggttgcagagacatgtggagtatctggagcactgtctcaggatccttcctctcctgctggatgctaaggaccttaaggacaagagctatctttgcttgcaatttatttggcaggccctgcagggctgtgcaaatgattctatttaatttttactacttgtgagaaggcacagagggctttgagagggcacagagggcctcttataatgggtagatatgcacattagctgatacactggaaactttccagcaggcatatccttccaagatgataaatattcctccttgttggagaaattgaagacatttgtacttgcaatctagcttatctagtaaaacaagacaaactaaccagtgatagggagaaacatgtttgcattattttccaaccttgaaaataatgtcagattattggactgagaaccaatgtcatcttctggatcttgtaattatttggacaaaatctctttgattctaggttcaaagtcaaggtgtcaaaaaaaaaaaaaggatacaactgttaagcttatttaattatacctctcactgtacaaataaggaaactaggccaggcgtggtggctcacttctgtaatcccagcactttgggaggacaaggccagtggatcacctgaggtcaagagttcgagaccagcctggacaacatggcaaaacgctgtctctactaaaaatacaaaaattagctgggtgtggtggcaggcgcctgtaataccagcgacttgggaggctgagacaggagaatagctagaacccgggaggcggaggttgcagtgagccgagatcatgccactgtgctccagcctgggtgacagagtaagactgcgtctcaaaaacaaacaaacaaaaacaaataaggaaactgggctcagagagatgaaggtacacaggtgatgggtagatagggacaaagaaaagaacctaaccctttggactccccaagccattctaatatttgtttttgtaagttagtagcttctgcacgttagtatgtcagaactcaactagtttcctatctttcctgataacctctccgacccacccatgatttagctaacatctgatttggtcaaccaagcaccctggtcctcaggttcagtgtgagacttaatgaaataggcgtgaatttttttttttttttttttttagacggagtctcgctctgttgcccagcctcgcaatctcaactcacttcaacctctgcctctggggttcaagcgattctcccacctcagcctcctgagtagctgagatcacaggcgcccgccaccacgcccggctaatttttgtatttttagtagagacggggtttcactatattggccaggccggtctggaactcctgaccttaggtgatccacccaaagtgcttggattacaggcatgagccaccgcgcctggctggcatgaattttttcttctgtccctagttcatcttcaggtcactgtctgattttattagttctcaaatttaaatcactatgcatgctcagctcttctagttatttcccttctttcctcatgttgggaaaaaaaccccgatttattctaattgtgagaaatgaaagcgaacaaatcctatcattccctattgtcttgtgcaaatatgaagagagatatgatagtggggtaaataaaagcatcagggaatccattcggcagaatctttctcctctcagcgtgcttgcagttagatattctgagattccagtggagaaatggtatggtggaaacattgaggttcaacaaggctcaatttagggcatattttattcagattctaccatatatattgtctaaaatgaaacaacactggggaatgaaaaggttggtcgaagatgcaagttgcctttattaaataaagacaaatatttaataaaaataatgtataaaaataatcacaattcactttcaaatctgaaaatactgagttttccaggctacacataaataaaactgccaacgatgacaattccagcaactaggaaaacaagtacgcctacaaagaaaagtgagaaaattcatggagaatttgaactcagaaccaactcctcggagctgatcttttttgggggaagccagggaacgcgccgggcgctctcatcagcaagaccatgtttaaagagagtgtggaagcacagaccaaaatggacattcgagggcgaacagcagctggcaaagggataagtgatccgaagcattaaagcccttgagacaaattccggcgcgaaccgccagtgggggatgagactcgcaggcgcagccctccaggccccggcggactgacacgcacgttggaaacggagtcacccaccacagccccgcagctccagccaaaatggcgccgccgctctgcccaccccgcgcaccccaggcggccgccgagcccgcgcgcgcgccctgtggagcgaggacgccggggacgcggccagggacgcgcgcgtcctcacggcggttgcacgcctgcgcgagggcgggcggcgggggcgcgcgcgcggcgggggcgggctttgccgagcgcagagctgcagccgccgagccggacgtgtccgcgaagatggcgggccgggtgagtgccggtctgggagcccaggcttgaggcaggggcgccgggctcgcgggcactctggggtccaggcggccccagaggagtgggagtgaatccgagcaatggggcgcgaggccagagcgggacttgagggtagcaggggagcggtggcaggggattagccctcctcaacaactccacccccctcgaggggagatgacccctcgttacacgcgtctgctgcgcctcccgtcatcctcccttcccatcccttggggcttgttccctcgtcctccacacagccgcagggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaaggtcgttgggaaagaggagggggtgccaatgacttttagtgttaaagcccggccatctgggggacctgtcaactgtcgggtcaggcaggaattggctttagcttggagtgaggatggatttggggtgtcacgttttgtttttatggatgacagtcgcttcgaatgcagcaggatatgctgtagtttcagggttttaaatttacttcctcctttagcctttaggatcgttgggtaggatgggtttggcgaggagagagagctggttgagtgctgtattgcagtctgccttgagctaaaagctctcaagggatgagtcctgcccggagattacactggtcataaacctgaggacattaactgcgtcattgggggcgaaagatgtgattgactgatctatttataacagaatttttgaataagtttgcatagatttatgcatatatgcaaatgccctatctgaagggacttgtaggtcatgagattctagagtaagaagggatcttaaaggtcatttagtttggcttctttctcttccttttccccatggcctctccttttaaggctagtccttctgccagtacttcagaccctatctgtatattcacctgctccttcttaacataatcaagcttctctatcttaaacccttcccccacccccacagctgtcaccttttcccgtcccagtttacagcaggaaatttgatagagttgtctatatttattgtcttccatttgcttaccacctactcacccttcaacctactgcagtctgatttctgccccatcatcccactgaaacctgtccctcaacttaattgatacctttcaatccttatcttatttgatatctcagcagcgtttgacgttgttgaccatggcttccttgacggaaagcactcttcacatgtgttctggaatgcctcgctcctggtttgactcagacctctcttttgcggcctcaccctcctctactttgttattcattgctggtattcctcaaaggccgtcttctcactctcaatttcccgctcaggcaatttcttctaagcccatagctacaactgtctatatgccagtgattctcaatattttacccccagtccagacctgccctttaagtttcaggttaatatgtccaactgcttatttaaaatcaaggtcccgaaacgcagctttttcaactccgaacccaggatcttagcccacctaacttgtgtagatactcctcgacttaacgatggggctaccttccgataaacccattgtaagctgaaagtatcagaagttgaaaatgcatttaatacacccgatctaccgaatatcatagcttagcctagcctgccttccttacacatgcacagaacacttacattagcctacagttgggcaaaatcatctaacataaacctatattataaaatgttgaatacctcatgtcatttattactgtgctgatagtgaaaaacagaatggttgtgtaggtcttcaaagtacagtttctgctgaatgcctatcacctttgcactattgtaaagttgaaaaatgttaagtcaaaccattgtaagtcagggaccatctgtacctatccagtgagataggaatatctcactgaatgataccatcatccacccagttatataggctgggaatctgagggagggagagggtgggtaaccctttatatctctcttttgctgtacccatgtcctctgccctatcccccggtaaaatttgtcagagttctgctcctgccccccataaaggtatttaattagggccaaagactctggtttgggggaatggttgctttagactagttccaagtcacccactggactatctggattggtcacatgggttctgtcattttaacctaaaaatctccagtctgtccacctttccacatcttcatttttacctccttttcccaaactaccatcatttctggtctggactactgcaggaagcttccaagtatttttttgttcgtttgtttgagatggagtttcgctcttgttacccaggctagagtgcaatggcgtgatccctgctcactgcaacttccgcctcctgggttcaagccattttcctgcctcagcctcctgagtacctgggattacaggcgcccaccaccacacccggctaatttttgtatttctagtagagacggggttttaccatgttggccaggctggtctcgaactcctgacctcaggtcatccacctgccttggcctcccaaagtgctgagattcgtgcccggcctcccaagtagtcttcttagagcatgtggcccacctccaattcattcttgaccttcattgttccttcccgtgcctattactacttaaacccctcctcagcagcatcccattacttttgggagaaaaccaaatccttaatgaggccttcaggactctttgtggttctgctcctgcttctttccactcattctcttactctgtgtgctcaggttatatggtaaacgagcctttcaattccttgaacctgtagtttctcttaccacaaggtctttgcgagtggtgtttcctttctttgtaacgttcttccccccaaccatttacctcctactcagacatcacttagctactcaagggaggcctactctgaccccacattataagtcaggatcctttgttatatactcttgaagaactgtattcctctccttagagatttatctttttgttactttgagtgtgtgttattatttgcttctaccacttcacctcagtgaaaagcagagaacatacaagttatttagtcattatcaactgcgctttgtgtaccttgtgggacttaggtactcaatacatttttgttgaaaatgaatcagtctctgaacactctggtgatagatggtatattaccctaaagcttgcctgtaatgtcatacagctatgttaggtctttgttatctggagttccatgtaacttttatacgtagttactatttctgctgtttcaagccatacggaactaaacacaattctttttccatgtaatagctactcaagctactcatttacttgaatacaggttacatatctcctcagattttcgattttgcaagttaaacatcccccaattcctagcatatttcatattccaaacccttcatcatttaggctaccttcctctggaagtaacctaatgttactgttttgtcaacctttcttctaaaatgtgcccagagtggaacacagtgatcagagaagaatgtacttaagctattattgtcttgagatggacactaccattattcataccagataaaattgtattagcgttttttctatagtaaatcacattcttggctcatactgagcttgtagtcagtgaaaactcatgttcttttaaaatcagctccctagctccattctaggtttagagcagttttattgaacctaaatcaagaccttatccttttacaattcatttttttaggtcagtgcatgtctgctgtttgttgaggtaatctggattcttagttctttcatgttaggaaacataatagctgtctcttccagtttggttagatctgtaggtttaatcatgacttctgtttctacgtttgagttattggtaaaggatagaataagacagggtcagaaataacccttggacatgctgccagtgacatgcctctagactgatacccattaatacacttgggcactgttgcttaaatacagatgtgtctcatttaattccaacaaaacaacctgcaaagtaggtagtattatctttgtttttttgcagagagaaagagagagagatttagtaacttgagaagttcacatagccagcaagaagcagggtcaagatttgaactcagatcagcctggtactgttacctagttcaccagcttagttgcaagagtgtagtaaagactaggtttacctcacctagaactttttggacataataatgttcagaaactatcttctaccttttggaaaatctgaaaaactttggcccatctgattgtctatcatttcttctgatagcctttattttctagtaactactgagtgatttttagcaaaaatagttcaccttgttgcaatacttttatttgtgcatatttatggagtacatgaaaatttttttacatgtgtataatgtgtagtgatcaagtcagggtacatgagtccaatgtattaagtatagtcatctactcagctatcaaacattgaatttattcctcctatcactggatcttttttttttttttttgagacggagtcttgctccgtcacccaggctggagtgcagtggtgttatcttggctcactgcaacctctgcctcccgggttcaagcgattctcccgcctcagcctcctgagtagctaggattacaggcatgtgccaccacgcccagctaatttttgtatttttagtagagacagggttttaccacattggtcaggatggtcttggactcctgacctggtgatccacccgccttggcctcccaaagtgctgagattacaagtatgagccaccgcgactgacctcattggatctttttaccttttaacccacttctcttcagcctttctctcccttactccgccttcccggtctctgttatctatttttccactccctgcctccttgtgttcaaattttgtagctcctacatatatgtgaaagcatgcaatatttgtctttttgtgcctggcttatttcacttaagagaataacctccagttccatccacattgctgcaaatgatatgatttcattctttttatggctgaatagtattccattgtgtacatgtatgacatcttctttatccattcatctgtagatggacacttaggtggttgattccatatttttgctattgtgatagtactgcaataaacatgcaagtgcagctatccctttgatacattgatttcttttcctttgtgtagatacccagtagtgggattgctggatggaaggtaattctatttttagctttgagaaatctccatacagtgttccttagtggttgtactagtttacattcccaccgacagtgtatgtgagagttcccttttctctgcatccttactaacatctgttactttttgtctttttaataatagccattctgactggggtaagatgatatctcattgtggttttgatgtgcatttctctgatagtggtgtggaacatttttccatgtcttcttttggccattgtatgtcttcttttttaatgggattatttgttattttccttttgagttgttcgagttccttgtatgttctggatatcagtcctctgcttgatgaatactttgcaaatattttctcccattcaacaggttgtctcttcattctgttgattattcttttgctgtgcagaagctttttagtttgcttaagtcccatttgtttagttttctttatgttacctgggcttttgatgtcttaatcataaattctttgcttacaccaatgtccaggagtgttttccctagactttcttgtagtatttttatagttttgggtcttaaaatcttcaatccattttgagttgatttttgtatatggtgagagataggggtctagtttcacacttctgcatgaagttatgcaattttcccagcatcatttattgaagacagtgtcctttccttagtgtgagttcttgtcagtgttgttgaagatcatttgtctataattatgtggttttatttctggattctctattctgttccattggtctacatgtctatttttataccaataccatgctgttttggttactatagctttataatatattttgaagtcagataatgtgatgtctgcagctttgttctttttgcccaggtttggtttggttgtttgggcttttttctttttccttttttggtcccatatgaatcacattggtattttgatagggatttcattgaatctgtagattgctttggcaatatggtcattttagtgatattaattctttccacaagcataggatgttttttgatttattttctttcattggtgttttgtagttttctttgtagagatctttcacctccttagttaaatgtattcctaggtttttgtttgttttcggtagctattgtaaatgggattgccttcttaatttctttcttggctagatccttattgatgtatagaaatgctactgatttaaaggttttctaaacctacagatatataatcagcaaagagacaatttgactttctcttgtccagtttggatgcctttcatttctttctcttgtctgattgttctggctaggatttccagtactgtggtgaataggagtggtgaaaatgggcatccctgcctcattccagcttttagaagaaagatctcacctctcctcattcagtatgatgttagctctgggtttgttgtgtatagactttattattttgagatatattccttctatgcctaatttgttgagagtttttttaatcatgaagggatgttgaattttatcaaatgtttttgttgttgttgcaatactgttttttttttttttttttttttttttttttgagacagagtcttgttctgttgcccaggctgtagtgcagtggcgcgatcttggctcactgcaacctccactcactgggttcaagcaattctcctgcctcagcatccctagtagctgggattacaggcctgtgctaccacacccagctaatttttctatttttagtagagacagggttttgctatgttggccaggctggtctcgaactcctgacctcaagtgatttgcctgccttggcctaccaaagtgctgggattacaggcgtgaggcactgagcccggctgttgcgatactcttaatgggttttatatttcctttttgtgggggacagtttattttgcattcttactacttttgatattctgacatcatcttataagtgggatttatattcactatgtaattgaagttttttccaatgaagcaccgtatatagtttatctgggaaattggctgaagaataaaatgtgtgatgttattcagtgtacagtttctaggtcatcagaagataccactaccttcccactactggaaaagaaaaaagaaaagttttccacagtgcctgaactgttttgtatgcttatcttttaaaattgccagaaatctcacttactggagattcagcagtccctttctgaaaatacacatactttagtgcaaataaagccagtggatctctttcttcataagtccttaaacctagtcgaggtcatctgtttggcagagataggagtaagataatgtgaaataggaaccaacgagagagaacttgcttaggagttgaaaggggtatggaaagatgttagaggtaaaatttgtcgaatctagtgttttgactagggcaggccagaatattcagtatcagtatcaatatcagaagcttttgtagcctttgtttagaaacctagtcatttataacattttgtgggtgaatgacatcattaccaaacaaactttcagatgaaactttggaactcaagctgtaaattgtggatagctcatgtgcagtactacaaatcaaaacaaatactataaagtgtttggtagtccatttcctgaatgaaagtttgtccaaagtatatcaactttctgcagtcttacatgcagtagttattagttttgtgtatcgctttagtggatatttttaaaagtatcttcaaatgcaatgaattttaggaaacaaaacaattctttaaagcatcattagatagcttcttctttctgaaacccagaggaatttatgtataggatgactctttttttcaagtagttaagttaaggtgcaaaagtataaggtaaagtatattatcttaccattgaaaattttggcagtggcagaagagcgaacccttacaaataccttcattgggcaatacactaagcacttgctgtaatgctttttaaaacatctatactctggctgtggtattttaagtgaaaatctctcagtgagatactctttcgtattttagtactgatatccttaatattgctctgagagctaccttatactgacttcagtttcctagtgatttaaactactaatttccaacttatttttttttatagtgaaaactaaatattccttttgtagatgtaaccatttctggaagccctaagtatttttgaatgagtataattcatgcacactttaagagatttcaagcatgacaagtacagtgaataacatatatccatgtgattaccactgaggtttaagaaatgttaacatatgatatctgcttcagatatttatctttttaaaaatagaacattacagctgggcatggtggctcacacttgtaatcccagcactttgggaggctgaggctggtggatcacctgaggtcgggagttcgagaccagcctggctgacatggagaaaccccgtctctactaaaaatacaaaattagccgggcgtggtggcacatgcctgtaatcccagctactcgagaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctccttttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgtgtgtctttaaaatgtatataatggttttatgctatatctttctttctgcaacctgcatttttcacttaaaataattttgaaatttagtcctgtggatatatagtgagccaattaattctgcttagctactctgtagtctgttttgtgaatataccacaatcatctactttcttattagaggacaatttaggcagttccaattttatttttcccggaatgtacattattttagtcgagtgccattgccacattagcgatattttggttagtgagggactgcagataggaaggtgatcccaaaagattataatgccatatatttactctacctttctatatttacatatgtttagttacacaattacccattatgttacagttgcttacagcatttggtgctgtaacatgctgtacaggtttgtagcctaggagcaataggctataccgtataggtttgtgtaagtacgctctatgatattcatataacgatgaaatcacctagtgacacatttctcagaatgtatccctattgttaagcaacacatgagtgtgtgtctccatgcatatatgtgtaagagttagcatgtgtgtccagaggtagaattgctgggcgataagtcatactcatctttacctagttatgccagtttatactgtcactagcagtatatgagtacctgttatttatatcctctccaacacttaatattgctgacattttaacttttacaatataataggtgtaaaactattgtttaaatttgcatgttgtcctcattactagtgagattaagcatttttcatattggtcattgggatttccccttctgtgaattacttttgtatatttgctcattttttctgttgggctgtgtatttttttagtgatttgtataatttttcgttttttggggggtagggtatgctttggattctaatcctttgttgtaaatagcttctctcagacagtgatggtcttttcatgatgtttatagagtgttggatttaaattttatagttataattaccctttttttttttttaccttggtgatttgtgcttttatgtgtttttcaggaaatctttctccaccctgaagtcattttcttataaaagttttaaaattttgccttgcacattttggtgattgatcaggaatttatttttgtgtttggtgtgaattatgaactaattttatcttttccatatgtataaccagttgtctcaatatcatttattgagtccatttttttcctttactgatttgcaatgctatctctgtattatatccagttcccatatacgtgtgggtctaagtgtcgactctattccgtttcataattctttttgtccatatttgcatcaataacactgttttaattgctgtagctttaaaattattcttgttatttcatagggcgtactttcattacctttcttaatttggcatttcttggctcttttccgtatgaattctgggaacaacttaatccccactcctttaaaaaaaaaaaaaaagacactttggcctggcatggtggctcacacgtgtaatcctagcactttgggaggctgaggcgggtggatcacttgaagccaggagttcaaggccagcctggacaacatggcaaaaccctgtctctaccaaaaattagcgggcatggtggcacacgcctgtaattccagctacttgggaggctgaggcatgagaatcagcttgaacccaagaggtggaggttgcagtgagttgagatcgtgccactgcactccagcctgggcaacagaacgagacagttttttgtttgtttgttttaaagacacttttaaccttccgctatggatttttgacctacatttttcctcttgtattttataagagtagacacagagagcacttcaataaaattcagctcaataactttattaacctgatctccttttctttgactttaagctgaaagtgttaatttctcacaacttgtgctctatagatttgaaaccaaatcaattagcatcagctgtttatgagtaatgcagggtattttggtcttttgctaaattcagaaagaaatgttaaagtgctgatggatttgcactagctgtatagatctttggtggaggaggaaatgggaaaattattaatttcaggtaagaagtcatttttgaaatgcaagattcatttctttttaaaatcaccacataataaaaactttaagggctgcattggtgggtttttaaaaaaaattgtgaagtgtttttagtgttatgtgctgacaaatatttttgtagttgctttgacaagcaatgaaactaccaattatcactaattctgagtcttccaatgaacctctgtgtcaaatttttaaatttaattatcctatttttctcctagagaataatattgatataattttgtgaaccatagcagacagttcccattgctgagaatagagcctggtgtggggatattatgattcttgaatggttgaacaagacatttgcttctgaacatcttagtaaattatcacttctgacaatgtctgtagtttgaattttgatattctctgccaaggtattgaatactctaaataatgttgtttattctattatttaaatcattagtattatagatctagctttaaacagctgctgcactccagtcctttttcttcacctgcagatattgagtctgataactgttttgtatacatagcctttcagtaaatctacttatcagtcatcaaattaacttaattataagttaaatgatgagatggaccaagagtgttattgaaatctcatttccacacatttcttctcttcttttgtagaaggtaatgaaatgaacctgtcagtgttcctgtttttatgaagtttatttctcttagtacagtgattctgatagtgggttctgcagaccagcaaattagcattatctgagaacttgttagaaaagcaaattctcagttcccacttcaggctgactaatttagaaaccctggggtagggcttagcattctctttcaataaattctccaggtgattctgatgtatgttaaagttgagaagcattcacttagtgttttgagctctccaatttagttccttataaattgttgaagatattttttccagatttctttccaaatatgtgctcaaccttgttactgataggtttcaaggttatcgtcttcttcccattaataccttcatctatatccaattttcaaacttttaagaaagcatggctattttgctgcagtatggtgaattaggtactctgactgaccttcccagataaacaatttaaaattctagataatttttttttggagggaggacagggtcttgctccgtcacacaggccggagtgcagtagtgtgaacatggctgactgcaacctcgacctgttgggctcaagcgatcctcccacctcaacctcccgagtagctggggccacaggtgcacaccaccatgtccagcaaatttttttattttttgtgcagatggggtcttgccttgttgcacagactggtctcgaactcctgggctcaagcagtttttccacctgggcctctcgaagtgctgggattacaggtgtgagtgactgtgcctggcagatgaaatattttttaagtaaaaaccttatgtgcatggagatagctggctgaaaagtaaggaataatcaggccaaaaactatgtgaaggtgaaaacccagagatataagccaagtactgctgccttgaggacattatttgcaaatgacattacttggaaaacctagttaacttgtgcttgtgcctcaagaagctcagagaacggaagataaaagtagttttctggtagaacgtcccacctctcctggtaaagatggtaccccaagggtctatacatcataataaatgagaactagtaataaacgtaccttgtctaaggatcggaaagaaaaatttcctgcctcaaactttggtggtgatgggaagggtacagaaattccctgagaagttttacccacaagctgaccttcatgcaggtttgaatcctgattttatattacctggatggtatgaaaatcttaagccagtaattaaatataaaagtggtacaagagtgacgatgccttaaaatgcctaagaatgcctaaaaagcagcaaatacaaagcttcttgggagaacccatcttgatcttaggatttagaaaattcctaaacataaagctgtaagaaatatgaactcacattcacaaaatgcagaaagaaataagatgcaatgaatgagaggaagcagaaacaataaagagcagaatcagaacctgcaaagagttcacatattggagttagcagacacagattataagtacatatatttaatatgcttatagaaaaaaagaaatttaaaataggaatgaggagcaagtatacaaaaatgaccagtgtacaaatttaataacagattagacacagctaaagaaagatttagtaaagtggatctgaaaaaattgcagtatagaggcaagaaaatgaaaagtaataaaagagttaagagaatacagagggtagaataagaaggttcagtctagtcagaattctggggcaggggagcaggggcatggaaaagaatgaggcagaggcagtatttgaagagataatgacagagaactgatgaaaaacaacctacaaatttaggaagctaaagaatcccagaaaggataaaaagaaaaaaaattcacacataaacattttttaaagaaactacatgataccatagagaggtcttaaaagctgtcagaggctgggcatggtggctcacgcctgtaatcccagcactttgggagcccgaggagggtggatcacctgaggtcaggagttcaagaccagcctcaacgtggagaaaccctgtctctactgaaaatacaaaattagccgggcgtggtggtgcatgcctgtaatcccagctactcaggaggctgaggcaggagaattgcttgaacctgggaggtggaggttgcagtgagccgagatcgtgccattgcatgccagcctgggcaacaagagcaaaactccatctcaaaaaaaaaaaaaaagctgtcagagaaaaaagatattaccttcaacaagtatttggctgtcagctgttttcctgtctataataatgaaagccataagacagggagtaatattttccatatgcttagagaaaataattgtcaaccaagaattgtatatcttgtgaagaatgggggcaaaattagacactttaaaacagacaaacactcaatgttgtaaccatcaaaccttccctactagtggaaattcagatcaatttcctgaaggctaaaaaaaaaaaaaaaaagtgaccactgatgtaaagtctgagatttaagaaggattgaagagtaaagaataatggtaaatctgtggatatattgaaataaatattggctttataaaatgatgtatgcggaggttttaaaaatagaactaaataggccaggtgtggtggctcacgcctgtaatcccagcactttgggaggctgaggtgggcggatcacctgaggttatgagttggagatcagcctgaccaacatggagaaacctcgtctctactaaaaaaaaaaaaaaaaaaaaaaaaaaattagccgggtgtggtggcgcatgcctgtaatcccagctactcaggaggctgaggtaggagaattgcttgaacctgggaggcagaggttgcagtgagccgaaatcacgccattgcactccagcctgggcaacaagagcaaaactccgtctcaaaaaaaaaaaaaagaactaaatatatgataacaacatccaaatcaaaagagtggttaaagtattttatgatctttatactgttgaagagaaaggtaaagctattcaattaactttagattttgataggtatgtgtattagtattttcagagtaactactaaaataatataaatattaggaataatttatagcagaaaaaacaatttttaaaaggcaaggaagaagtgaaaaacatagaaaaggtcagataaagaggaaacaataaaatatagaaatcaaatcaaatatatggtagactaaatgcttcattcagacaaagaatgtcagattggattatttaaaagcaagcaggccgggtgcagtggctcacgcctgtaatccgagcactttgagaggctgagacgggtggatcacttgagatcaggagttcgagaccaccctggccaacacggccagctggccatggccagctaatacaaaaattagctgggtgtggtggtgcacacctgtaatcccaggtacttgggaaggtgaggcaggagaatcacttgaacccaggaggcggagattgccgtaagccaagatcatgccaccgtactccagcctgggcaacagggtgagactctgtttcaaaaataaataaataaataaataaaagcaagcaaacaaacttactgaaacaacacaaaatccagctataattttcaagagagatagctaatacatatgaatgtagaaagatagaaagcaaaaggatggaaaaagtctatcaggcaaactctaaccaaaagggaggtaaactaactatattagcatcagacaatatgatctttcagacaaaagagacagctagagataggtccctcaacaatgagaaaaggtttatttatccataaaggtaaaaacaattccaaacttgtgtgaacctaataattgcctcaatatacaaagaacaaaatgacacaattataagatgaaatagacaaatctaccatggtgaggagtttcaaaactccctaattgaaaaattaaaaagacaaaatggttacagctgaaaattaaaattaaaaattcattttctcggttgcaatagccatttttcaagggcttactagtgacatgtgacaatggctgctgtattggacagcacagaaagtacttttgcactgcattaatttagaagacttaatataattaacaatattaataattgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaaaaaagtgattaattggatttcatcaaaagacactgacttagtttgcttaggctgccataacacaatactatagacttggtggcttaaacaaaagaaatgtattttctcacggttctggaagctggaagtttgggaccggggtgccagtatgactgcgttttggtgagcactgtcttcgtgacttgcacacaggcttcttgccacgtgtctgtgtggcggagagacagcaagatctcaccatctctcttccttttcttataaggccacagtcttgtcagattagggcccttcgcttatgacctaatttagcctcaattatctcccaaagtccctatctccaaaatagttggggtgggggaagcgccttgactaatgaattttgttgggggcagtggggagtgcacatttcactccatagtagacaccattgaggagaaagaccagagtggaagaaggtatttgaaatacatgtatttgacagccaggcacggtggcccacacctgtaatcccagcactttgggaggccgagccgggcggatcacgaggtcaggagatcgagaccatcctggctaacacagtgaaaccccgtctctactaaaaatacaaaaaattagccaggcgtggtggcgggtgcctgtagtcctagctacttgggaggctgaggcaggagaatggtgtgaacccaggaggcggagcttgcagtgagccgagattgcgtcactgcactccagcctgggcgacagagcaagactctgtctcaaaaaaagaaaagaaaaaaagaaatacatgtatttgacaaggacttgtacctggaatatataaagaactacaaatcaagaataaaaagaaaggacagaaagccaatggaaaaatgaacaaaggattcaaacagggatttcacaaagaacttacctgtaacgtatgttaaatgctcaacctcattagtcatcagagaaatacaagttaaaacctcagggagatattactacacacccaccagaaagttaaattaagaacacatttgtcatgacaattctgggtttgattttgttttgttttttgagatggagtcttgctcttgtcgcccaggctggagtgcagtggcataatcccagcttgttgcaacctctgcctcctgggttcaagtgattctcctgcctcatcctcccgagtagctgggattatgggcacccaccaccacgcctggctaatttttgtattttagtagagatggggttttgccatgttggccaggctagtcttgaactcctgatctcaagcgatccacctgccttggcctcccaaagtgctgggattacaggcatgagcccgcgcacctggcctgtcatgacaattctaagtggtgatgaggatgtgcagcagctggaactgatgaaaatgcatgagcacaacctctttggaaaactagcagaattccctaaaactgaatgtaggcatgatgcccatgacccagcacttatagtcctgggggtgggaggagtgaatatatttctattcatgatttctatctctgatgacagaaattaagctagtgggtatctgtggttgagtagaaggatagtgactaggagcgggcagtatgggatgctggtaatgtcctcttgacctaactgttggttaccctgggtgtgttcacttgtagaaattcattgagccaaacacgtacaatgtatgcatttttgtgtatatatgttcttcttcaataaaaacttgatttaaataatgttctttttcttaaactgggtagtaggtttatggtgttttatgtgttgcctgtgttttatacatattttattcctgttcagtgtccaaaaaatataaaaagtagtcactgctttgttgttaatttgagcatctcctgcacctagcacagtgcctgggacattatagatatttattaaatatttgttctatggaaaagaagtaggctagtaatttctttttgctttccaacagccagtttttgattcaattatttgtaaatatgatttctactcagttgtttctaaataataaaatatgtaaatactattatgtttatatttattagtaagctgaatttattaaatgagaaacctctcaatattaaggacacatcataaattattagcatgctgtgttataatgactaaaagtagtatcaacaatttagataagtatagtgtggccttacggatgtaagtccgtaagatcatgcagcattgaagatgtgcagtttactagatcttctaatattctcgggtgtctcactgtttcttttttcttttttttttttttttgagatagggtatcactttgtcacccagtctggaatgcagtggcgtgatcagggctcactgtagccttgacctcctgggctcaaacctctcaccttagccccctgaataacggggattactgatttgtgccaccaagccaggctaatttattttctttctttctctctttctttctttctttctctctctctctctttctttctctctttctttctttctttctttctttctttctttctttctttctttctttctttctttcctttctttctttccttctttctttcttttctctctttctctctctctctctctctctcttcctttcttcctttctttttgtagagtttgggtctcactatattgcccaggctggtcttgaactcctggcctcaaatgattctccctccttggcctcccaaagtgttgagattatagttttcagccaccgcacccagcctcactgttttcttcagttgtttctgaacaactggaatctcagctgtctttttccattaaatcccgtgttcgttcctccataccatgctgcctcttgcccatttttgcatttctcctttctgctttcctgaacattctgagtcttactgggctggcattcccttgttgggacaggggagaggctctaggccttggatccttgttctgattccttctccaaagagttttccctttttcttcccctttcaaaacaacataagtgcaaaagctttgtcaggatgttgggaattaaaaaagcttcagaaacattttgattcatttaacaacattactctgaaactttttagagtaagagtaccaagtcactgaataagacgatcttgaaattaaacgatattttacagttttaaaaacaccttcacagatcttttcttattagattctcagcacaaccttatgagttggcactgtcaaaattcagttcaacaaacaaaatccaactaacaggaaaactcacagctaacatcatacttaatggttgaagactgaaagctttcccccttaagatcagaacaagacaaggatgctcttgccactcctattcaacactctattggtggttctaggtggggcagttaagcaggaaaaagaaaatacatttatatcagaaagaaataaaactatatttaccgatgacatgatcttacatgtagaaaaatcctacagaatttaccaaaaaaaattggaactaataaatgagttcagcaaagttgcaggatacaagattattatctaaaaatcagttgcattcctatatgctagctatggataatctgaaaatgaaatagaaaaaattccatttataataacatcagaaagaataaaatacttatgaataaagttaaccaaagaagtacactaaaaagtacactaaaaaacagaaaacatgttgaaggaaattagagatctaaataaattgaaagacgtcctgtgttcatggcttggaagacttaatattgttaagatgacagtgctacccagatttatctacaggtttaatgcaatcactatcacagttcaactgcctttttcccggaaatggacaacctgatcttataattcatatggaattgcagagccatatttgccacaacagtcttgaaaaaaagagaacaaaattgtaggactcatacttcctgatttcaaaacttattacaaaactacagtaatccagatggcatgtcactggcatgaggagagtcttgtaaaccaatggaatgcaatttagagtccagaaataaacccatacatttatggtcagttgattttgaccagggcgccaagatcattaactggggaaagaataatcttttcaacaaatgttgctggggcaactggatatctacatgtaaaaaaataaatttggatccctgcctcacatcacatatgaaaattaactcagaatggatcaaagacctaaacctgttaagttcttcgaaggaaacataggtgaaaatctgtatgaccttggattaaatggtgatttttaaagatataacacaaaaacacaagcagtgaaagaaaaaggtagataaactggactttgttaaagttaaaaactttcatgcatcaaaggacactgtagaatgaagacaactcacagaatgggggaaaatatttgcaaattatatctctgataagtatatatattttatatatatgttgtttatatccagaatatgcaaagaaccctttcaactcaacaaagataagacaatggaatttaaaaatgggcaaagcatttgaatagaatagacatttctccaaagaagatgtacaaatgacctataagcacatgacaagatcttcaacatcatagtccatagggaattacaaatcaaaaccacaatgagagataacactttacaccctctaggatggtcatacttttttttttttttttttaaagacagtaacaagttttgataaggaagtagagaaattggagccctcattgctgatgggaatgtaaaatgatgcagctactgcacaaaagttttgcagttccttaaaaaactaaacatagaataactcagcaattctactcctgggtatagacccaagataattgaaaacatatgttcatacattaacttgtacatacattaacatgtggcattattcatagttgccaaaaagtggaagcaacccaaatgtccatcagctgatgaaatgataaatacaatgtggtatatccatacaatgaaatcttatccagctgtaaaaaggaatgaagaagccaggtgcagtagctcacaactgtaatcccattgctttaggaggccacgatgggaggattgcttaaggccaggagttcaagattggcctgggcaacatagacccagtctctacaaaataaataaataaaaagaatgaaatactattacgtgccacaacatgaaccttggaaacattatgctaggtgaaaatccagtcaccaagatgacgaattgtatgattctgcttacgtgaaatgtccacaataagcaaattcatagagacagaaagtagattagtggttgagaaggagtgagagaagggatgaattgagattaacggctagtagggacagagtttctttttggggtgatgggactgttctggaattagatagtgattatggttgtacaacatagtaaatatactaaaaaccactcaaaggctgggtgcagtggctcatgcctataaccccaacactttgggagactgaggcgggaagattgcttgaggccaagaggtcaagaccagcctgggcaacacagcaagaccttgtttctacaaaaaaaaaaaaaaattgttttaattacctgggtatggtggtgtgtgcctgtagtcccagctactttggaggctgaggtgggaagatcacttgagcctgtgaatttgaggttacagtgagctgtgattgtgccactgtgatccagcctgagtgatagagcatgaccctgtctctcaaaacaaaaccctccaaaaaacaaaaaccacccaagtatacattttaaatgattaattttatgtgaaatatatcagctgggcgtggtggttcacacctgtaatcccagcattttgggaggcagaggtgggcggatcacgaggtcaggagatggagaccatcctggctaacatggtgaaaccccgtctctactaaaaatacaaaaaattagccaggcatggtggcacatgcctgtagtcccaactactcaggaggctgaggcaggagaattgcttgaacccgggaggcagaggttaaagcaagccgagatcatgccactgcactccagcctgggcgacagaacgagactctgtctttaaaaaaaaaaaaaaaaaaaatctcaaaaacggcaatgagaactcaattaatatttatcatactgtatattccctgagtggtgcaggagaatcagagcttagaatcttgtgaggaaggcatggtacttaaataagtctagtgtaaggcagcttgtaataagtagtactaagactgctgaagaagcacaaataaaggagatattctatcttactaggaaccagggagtttcacaaacttggctttgcaaggtgggaaagattttcacaggtggaaggggtttgaaatagggaattcagtcaaaaggaatagtgtgagtgaaggaatggagtttggaatgtggggtacatggggttggggtggggtattgaggtagatgacgcagaaaaataagttaaagatagatcttgcataggtggctgtgagtagcatgctaaggagtttgggctttattacttatgaatcatatttttggtttcaggtcatgtctggtggcagagggaaggctgaattggaggagaacaaaagctagaaccagggacaacaattattaccattgtagttttttaggagaggtgatatggctgaactaggttatggttgtgaggctggaagggaggcacatccacgtgacagtgcagtagacttagtagactcttgattgtttatgtgtgcattccagggataggcagtgaagggaagaatgaccctgaaatcttgaatttaatgacttgaaaggataatgatggtattaacagatgaggaacatagcaagacaaacaaatgaaaaagtgaatactgaggagaaggaggtaccactgaatttggcatttagtcattggtgattttgaagacagcagttacagtaaagtggctgctggaaaggatttcaaagaatggttgaagaagatagccataggatgagaacatggaaggcaaggaagggagacttgagagatttggtaataaagagaagagagaaaagggtgctagtttgaaatgagttaaaagaactacagagtagaattaaaataaagtagaattatgggatttttgctttttaagtgacccatgagaggcttactggcagtgtgccaagattcaagagagcaaagattggcagggtgggattaagtgatgggatagccgggtgcagtggctcatgccggtaatcccagcactttgggaggctgaggtgggtggatcacttgaggtcaggaattcgagatcagcctggccaacatggtgaaacctgtctctacaaaaaatacaaaaattagccgggtgtggtggtggttgcctgtaatcccagctatttgggaggctgaggcaggagaattgtttgaacctgggaggtggaggttgcagtgagccaagatcgagccactgcactaactccagcatgggtgacagagtgagactccatctcaaaaaagagaaaacaaaaaacaaaaaaaaacgacggtagggagccttctgcctctttaaacatttgagatgcatgtcctgagatgcttctgtgaagttaagaatattaattttttgatacgaatctgacaaaactagacatcaaaatatgccatatatggtaattaaaacaatgtggtattagtatagaaagcagacaaatagttaatgaagtagaacaaccaacccagaaatagaaccagatacacctgaaaacttcatatatgaggtttaaaatcagtgtggaaagctggaaatcacccatagtttcgttatccagtcagttgtttttcacattttggtgtgtttccatttagttggtttgccatacttttttaaaaataatgctttaaggctgagcgtggtggctcacacttgtagtctgaagcaggcagatcacttgaggtcaggagttcgagaccagcctggccaatctgatgaaaccccatctctacaaaaaatacaaaaattagcctggtgtggtggtgcttgcctgtagcctcagctacttgggagactgaggtgggaagatggcttgagccagggaagcaaaggttgcagtgtgctgagatggcgccactgcactccagcctgggtgataaagccagaccttgcctcacaaaaaaaaaaaaaatgctgtaaagtaaaagttctgtatacaattctgtgatatgaaccctaccttagtgtgttatgaggattttgatccttatatgatatgatatatataatcaagtgcgggtacgttgtagtttacagaaccattactttgaaacaagacctttaggttactcctaattcatcactgttaaaataatgctgtagggaaaaaattacacataaaagttttctatatttaaaatgatttttgtgagacaaagtttatttattgtaaaaacagttccagcagttcagaattgtaaagagttttacagaattgtaaagagttcagaattgtaaagacattttcttgtctttctccttggtggtaaccactgttaacagtttagtgtgtatcttttttttaagtttagtttttatttttttgtagagacagggtcttgctttgttgcccaggctggggtgcagtggtgtgatcatagctcactgcagcctcatactcctgggctcaagcagtcctcccacctcagcctcccaagtagttgggactaccggcatgtaccaccacgcctggctaatttctgtatcttttgtagagacagggtttcaccatgttgcccaggctggtctggaactcctgggctcaggcgatccccctgcctcggcctcccaaagtgttgggattacaggcatgagccactgcacctggactagtttctttttaatttctgagtagtagtcaattgtatggctctcctataatttcttcattcattcatcttttggtagacatttgtgttgtttccatttttaggctattatgagtacagctgttgtgatcatttgtgtgcgagtctttgtgtggatatattttcatttcttttgactaaaaacctaggggtgcacttgttgggtcacattaactttgtagaaactgcattgcatctttgccgatattgaaagttgtcagcattttatatttttctgtgcatgcttttccccccaaaagaccaaaatgggaattgtttttcttttcattataaacttgtaaaggaattttaaagttctaagggatgccaggcaggaggttcatctatgtgaacagttattagtttgagatagataatgtcaaggatatccctaaaggcttttcaagagataactataggacatctaccccatcacttctagtcacatgtgacttcagaattttaacagaaattattattataggaatatgtagcacagagggattccataggcctgaagattagtactgatggcctttcttacattattctaggctggtgctatccgatgaaactttctgcagtgataaccactagccacaggtggcttttgaaacgtagggctagttcaactgaagaattgaatttaactttaaattaatttgaatagtgaaatatgtctagtgattaccgaacagtgtagttctgaaatgttatttttcaggaaagatcctctagcaagaagtagttgagtgagacctgttagctgagctggccctggggcaggtttgtgttttcagtccttccctttcctgtgggagaaatgaaaccaaagcctagagcaccacagaagaagaaccagtggattcataagggtgacagttcaggtaggggaagctgtttggtaatgagctcttttggtcagatgccacactatttttctttctgtttattttgccctattaaattatttagtaaatagtaaagcgtactttaatccagtttttaaagtggacgtttggatgaaagtatgtgatttaaattccaaaactgtgcagtgttgtccagaagagtcctgattaaatcaccccagtttctttgatgaagataagcaaataattttattttttgctgtaatcccagctactcggaaggctgaggcaggagaatcgcttgtaccagtccggaggctgctgccctctcacagggcttcctcctcttgcacagacgcaccagtgccttcagccccactggtctccctcttctcctttcctggcccctgctggcccagtagatgggccactggaggccactagatggggactggggaatgtgatgttggcgatctgcggtatcttcagggtgacagccatacccaacgcgtgggacctggcttccacatctatagacctgacctaaggaaatatgtgggcgtgtgcataaggatgccatctcagaactgcatattaataaaaagctgaatcaaacagtgtccaacaagggtggctgttccagctggtcatctacaatctcagctcactgcaacctccgcctcctgggttcaagcaattctgccttagcctcccgagtagctgggactacaggcacacaccgccacacccggctaattttttgtattttagtagagatggggtttcaccatgttgcccatgctggtcttgaactcctgagctcaggcagtcctcccaccttggcctcccaaagtgctgagattataggcgtgagccaccgcacctagcctgtactttcatttcttaataactgcatgactgtagtggttggctttcattattgtttcctaggggcaaggtcaatgttagaaaaattgtggaattttcccttggcattgctgtggtgagtagacagctactatttatagagacttatacttcgttgaaaaaatgagataccatgcttggcttaccataaaaacacagatgtttctggattccagtagggaggccttttgttcacagcatctgttttggttggccagccagatgacttctgtggattttttcactccttttgaaggacacttgacaaataaacaagtttataaatgaaagagttaacagcattttgtaaatttattttattactttagctatatcgttctgtatattttgaactatcagatcattttagctcaattttatcacttcctaaataaccttgagacgatcagtcctttgttacatgttctttggattgtttattctgcagttgagacagatttttattgatctataaatttttgtgttcaacaaacatttaatgagtattcactgtgtactaggccctgtactaacactgggaactacatatgtgagcaagatatagtctcagtctttgagaagtttagtgtcttatatgcagtgcaaacatgtagacagaataaaattatagttgagtgcttccatttgaagtttatttcatcagtttagtggggaggggtaggtgtctaggaatgccttccagaaaaagtagtgtctaagtggagaattgtagaatgagtgggagttgtccagggatggaacaggggttagtggcggagattatataaaagaaagaagcttgcaggtgaaaatgaccctgggaaagtgggaaactgaaaaagttcagtacatttctgtcatatggctgatcaagctgtgactgggcaaaatgctgtcagcatttgttgaacacataaatgctgtctcattcacaaaggagacttgtgacctagactttattcatcttgtgctaaattagtgatttccaaacatttgatcatgaatctcataagtaaaaaatgttttgattatgtatcctcatatattgattatatgccaatatttgtttatagatgatatgtagtactaaaagttatatacgcagtagaacatgtatagaaaacaaaaaaaattaaaaggatgagctaaagatggcatgtacaatattctcacagtgttaattttactgaaaatacggaaagtaggctgggtgcagtggctcacgcctgtaatcccagcactttgggaggctgagggaggcagatcacttgaggtcaggagtttgagacaagcctgaccaatatagcgaaatcccatctctactaaaaaatacaaaaattagctgggcatggtggcacacgcccgtaatcccagctactcgggagggtaaggcaggagaattgcttgaacccgggaggcggaggttacaatgagccgagatcatgccactgtactccatcctgggcgacagagcaagactccatctaaaaaaaaaaaaaaaaaaaaaaaaacccagaaagtaaagtggtacatcattatttaaaatcttcgtttaatattatgtgatacagctgctcagagggctgtttctaaattcagtttattttgatactttaatggcagtcaaagcctggatcaaaatggaagaatttggctgcactttctaaatcatattctttctttctccaaacttattcactatttatggaaatgctttattgaaatgtggctggtaaatatccatctattagtttttcttgcagattaataaaaatatattatacttttattgtgttaataaatgggttccaaaaatcactgttaagtcttcatttggaagatattttaaaaagttttagaatattctgtttctgactttataaagcatgaagatacgagtttttggtgtctttattttttagattttgtatatattgtttcaacagcagaataacttagcaatggaaatgtttccaattatccaattttgaaatgctctattaggaaagatttttttttctctcgctctcttttttttttttttttttttttttttaaagatgaagcctctctcttgtccccaaggctggagtacaatggtgccatcttggctcactgtaacctccgcctactgggttcaagcgattctcctgcctcagcctcccgagtagctgggattacaggtgcccgccaccacgcccggctaatttttgtattttaagtagagatggggtttcaccatgttggccaggctagtctcaaactcctgaccttaggtgatccgcctgcctcattctcccagagtgctgggattacaggcgtgagccactgcacccggccgatttttttctctttttcttttttctggaaaagctgaaaataattctgacatgttgctaaacatttttattttgtaggggcagagtgagtttttttgtttttttaatatcttcttggtagcatactacttataacctcctcagaaatatttagcaagtttggaactctagtctttttattttaaaaaaattgtgtaactcatctacatttaacaaatcttttaaatacatttcttgtggtaactagtgaatctgtgtggatttaaaaacaaaaaaaagattatgaggccaaggcaggtggatcacttgaggccaggagtttgagaccagcctggccaacatggtgaaaccccatctctactaaaaatacaaaaattagtcagaagtggtggtacacaactgtagtcccagctactctgagctgagaatgcgccactgcattcaattctgggcgacagagcaagactatctctcaaaaaaaaaaaaaaaaaaaaaaattcagtggctactctctatctcccagagtataggaagattctatattcatacagttaacctcagtgacatctgaggtaccttgttctgacttaattgcagcaatagtttacctgtgaatgaagctgttaaaggcttttgtatcagatgctatcactgtaactttgttctggaattttttttttttttgagatagggtctcgctctgttgcccagactggagtacagtgacacgatctcagctcactgcaagctccgcctcccgggctcacgcctttctcctgcctcagcctcccaagtagctgggactacaggtgcccgccacaacgcctggctaattttttgttattttttagtagagacggggcttcaccgtgttagctagcatggtctcgatctcctgacctcatgatccacccacctcggcctcccaaagtgctgggattacaggtgtgagccaccgcagctggccagaattcttttttaaaattccagtcaaagcagtcatttcatcagtggttacagttttcccataaagcaccttgtttcatttacagttaagaatacctcccttttaatacattgttccttggtatcttacaaagttgtatttcctgtatatttcataattacccagcaaataccctaagatgaaagaatcatctgtatttttatccaattgtatagcaaaccccacacactgtatttgtcctgatatcttcaagtctttagggttttctaagagcttttgactatacttaccaataaaagaatacatttagtttgtcaccacttttatttctgtgtataatttcagctatggtccttggctttttttagggaaaccttagcagtttcgacactaactttcgtacaattttgtgaagtgtcacattaaatagcctgtgactttagacataggtggaaaaattatagacgtttaactcttgcagtgaacacttaaaagcctggtggattatgaggactttgttcgtgccatcagattatatcttaaggtagagtagacatgtagagtgaggttcatctttaataaaaaatgggctgggtgcagtggctcacacctgtaatctcagcactttgggagaccgaggtgggtggatcacaaggtcaggagatcgagaccatcctggctaacacggtgaaaccctgtctctgatgaaaatacaaaaaaattagccaggcgtggtggtgggtacctgtagtcccagctacttgggaggctgaggcaggagaatagcgtgaacccgggaggcggagcttgcagtaagccgatatcgcaccagggcagtccagcctgggtgacagagtgagactctgtctcaaacaaattaaaataaataaataaataaataaataaataaatggtgtggctggacgcagtggctcacgcctgtaatcctagcactttgggaggccgaggcgggcggattgcctgagctcaggagttcgagaccagcctgggcaacgtgatgaaacccccgactctaccaaaaattcaaaaattagctggagcatgcctgtaacccagctacttgggatgctgaggcatgagaatcgcttgaaccagggaggcagagattgcagtgagctgagatccaccattgcactccagcctgggcaacagagagagactgtgtcaaaaaacaaaacaacacataaataagaaattgtgtgaagtcaatataaataccagtactaatattttatttttataccccaaaggattatcgtataatacaaacacccttcaagtacacatatcccactttggagactaatgccctaaacaacagggataatgatattgaaactggccttttagttaaaataaaagcaaagccaaaaataattcactttcctctataaatttatatttgggagacacatttaagaataatcgtcctggccaggtgcagtggttcatgcctgtaatcccagcactttgggaggccaaggtgggcggatcgtgaggtcaggagatcaagaccatcctggctaacacggtgaaaccctgactctactaaaaatacaaaaaattagctgggtatggtggcgggcacctgtagtcccagctactcaggaggctgaggcaggagaatgacatgaacccgggaggcggagcttgcagtgagccgagatcacgccactgcactccagcctgggtgacagagtgagactccatctcaaaaaaaaaaaaaaaaaaaaaatcagctttggcttgaggtttgaagaatgaacccttcagtcatagactatgactacctgtcatagctcactaggaaaccctagggaatcatggaagggttattggttaaatatattatataaaggaacattttgctagttgctattgaccaaaaaggctgtttttttttttttaaatatagtctgtaattatttttgttgaaagatatttggaagatggtttttctcaatctataggagatacagttcgtagccacctgggatctcttataaaaagatactttttcatagtatactctttataatatgcataacatttcataatatacttttgataatatacataaaatttgatacataagtttaccaaatttattgaatttacttcagtgcatttttattagtcaagattctttggaagatatggaaagctaattcaaaaaagcttgagcaaaaaaaatttgttggctcgtaactaatgttcaggactggtctcaagaacttggttgccagatctgtgtttccaggttatctattagcttgtctgtgtctctgtgatagttttacccttttagagtggaaaatcttcctccttgtggtgctctggcttgcagaagaatgcctttggtctagcgccagcatatataaaatcctgtgggtgggatagagtagatgtggttgcatgtgtgctgactggcagtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagtgagtatctgactttgttttcttttaacctgctaagtggcattcgggaaacttccagagagtcatttttaggaaacgttggaaaatatttttaaaaaattcttgctgagttggaaaatggagaagatgagaaaaagttatgtatttgaatcattactgtgtcaaactttgataaatactgtataatgttttaaaaatgttttatgtataaaactctagttttcatcagttttcttagtagagctaaacatactggttgtatgaatcatatatggcagagttgttaggtgtttggttctggcaaactcagattgtttgagttttcctggctctaccaattacaaactgtgtgaccatttctgtacctctatgtcctgatctgtaaaatggagatgatctcttcctcaaggtagctatgaagattgagttacataaataaagcacttagaacagttcccaacatgttaacaatcccttagtaaatattagctgttatgattattattaccatgataatccaagagacatgaacattggaagatgggctgggtatggaggcttacgcctgtaatcctagtactttgggatgccaaggcaggctgattgcctaagctcaggaatttgggaccaacctggccaacatggtgaaaccccatctctactaaaaataaaaattagccaggcatggtggtgtgcgcctgtagtcccagtttctcaggagactgaggcatgagaatcacttgaacccaggaggcagagactgtagtgagccgagatcgcgccactgcactccatcctgggtgacacagcgagactctgtctcaaaaaaaagtaaaggaaaaagaaaattggaagctgcaaagcaaatgtagaatccttaaaggcattttgcactgtaatttattttaactgatccatatcaccgcactgccaggacttctaaagaccctgctgcaagttcagtgccatccatatgcttctgagattggtacagataaggagatgaaggggctgtagggaaataagaggcaaggtggtagggttttaactgagcatttttcttaaaatgttatctgtgaaatacctgagtttcacagagttagaaatgctaatcatctttggtttccagcttcagagtaagaggctgtactatatggtgatattaacattgtttccagtgctaaacattctgtgatgctaaattgagcacaggattttcaacagataaactgaagtatagataatcaacgtgagaatttgtggaattcttttacatatgttaaatgttcactgtactcatggtggggttactcaaaatgtagttgatataaggaacatgtgttctagtggcaaaaaaaatacgtatagaaacattagccattgatgtgaaaaattacagcattctgaaaagataatgtttaaaaagatagtgagctaggcatgttagggcatgcctgtagtcccaactactttagagactgaagcaggagaatctcttgagcccaggagtttgaggccagcctggtcaacatagcaagaccacatgtattaaaaaaaaaaaaaaaaaaaaaaaaaaagatactgctgctgcataacaggatttgaagcttctatcttacacatagtactttttagttacctggtataggagattatcatgagaggactgttttttttttttttacaggtaatttctgaacagggaattagcacaaaattttttaaaacagtaaatattgatatctacatgaaagctgatgtattttgggaattttttaaatcttttttttttttattttgtaggttgtttttgttttagcctgttgagagagtctgcaaataaatttaatgagtagtctaaaaactaacttttttttgattgctatatcctagctcttttatctttggctctcttctccttattaggatgtgaagtaattctcaggagaggaaatgcatctagtttttacttgatatcaaggactctaaatcactggcttcagttttatgtaaactggaaatgtaaggaagttggtattttggatggtattttggctggattctacttgatgagtgtttgacccaaggtgctccttatatctggaaaacatttgggattgctgatagtttgggaaactaaatttgtggttctatttcttcaagacacagatagtgtcgtttccacctgatactcattaaatatcagtttgacaagaaatacattttgaaattatgttcttcatttccttcaatgtggagtactaactgtgtttctgtcctttaggcatgtgattgtgaggacctctcccaatcacaggtacacatttacactgaagacacatccatcggtggttccagggagcattgcattcagtttacctcaggtaactcagatgttaatttgttctcttctgtttttgaaagtcatagaatatgaataatctgttcattttaagcaagcatcaccctgtgactgtattgattcatattgaagaaaaatatctaagtattatataaggaatttaaagatacagtcttctttttttttttttcttttttttttttaagacagggtctcgttctgagacccaggctggagtgcagtggcacgatcatggctcctggtctcaagcaattctcatacctcagtctcccgagtagctgagactacagtcttgtaccactgtgcctgactaattttaaaattttttgtagagatggtgtcttaactgtgttgcccaagctggtctttaactcttgggctcaagtaatcctcccaccttggcctctcaaagtgctgggattatagggtgtgaatcatcatgcccaacctaaagacagattcttaattgccagtttttgctatggctgccttcttttggcttgattttttttccctaatttttaaagattttgcagtaaaatcagtcagctatcacataaagcgtcaagttattttaatgttaactgccagggtaatagaaaagtagaaaacattttatttgtgaagttgatatctaagaatggtgattttataatgtgatggcgttatactaaagaatttggaaagagtctcaaattacaacataatttgctaggctcccataacaactggatgggttgtgattacagttacaactgttgatggattctgtagaatccagagaattagattgcttagtgctgtcccaggcacatcatacataatataaagcaccaagaatactagtctgtatcctcttctcccttatcattttactcaggctgctgactgtccccagtcctaagtaatgtaaatggaattcctacctcctcctagtatgctaatgagcattggttgacttccctgaaggtttagagaaagagctcaaacactcatttaagaactattaggctgggtgcaatgactcatgctggtaatcccagcactttgggaggccaaagctggtggatcacttgagtccaggagttcaagaccagtgggcaacgtggcgaaaccccacctctactaaaaatataaaaattagctgagtgtggtggtgcatgcctgtagtcctaacttcttgaggggctgaggcaggaggatcacttgagcccgggaagttgaggctgcagtgaggcgagatagtgccactgtactctagcctaggtgacaaagtgagaccctgtttaaaaaagaaaaaaacaaaaacaaaaactattagatgggccaggtacctcacgcttgtaatcctagtgctttgggaggtggaggaggatcgcttgagaccaagaattccagatcagcatagcgagacccttgtcccccgcactagtctctacaaaaaaaaaattttttttaattagctgggcatggtggcacatgcctgtagtccaggctacctgggaggctgaggttgggaggatcacttgagcctaggaagtcgaggctgtagtgagctatgattgtgccaccatgctccagcctttgctccagagtgagattctgtctcttaaaaaaaagggaaaaaaaaggaactattgaagatctcttgaagccctcaaaaattacaggaaattttcacttactattccacctgtctgtttgatgcctcttcattatccagaccactttcacgtttgtttctatagattaaaagtttgggatattccagggttctccagcttttacagagttccatttgggattctgattgttagcaatagcttgaggtgtgacagtttctccttgtctctgttttgtaaaaaaaaaaaaaaaaatttccccgacattcactgtaggccagcctctattctaggtactttggcatgtgttagctcatttaattctccaaacaaccttatacaatagctactgttgttatccctaaggactgttgtattagtccattttcatactgctatgaagaaattctggagactggataatttataaggaaaaatgagatttcatggactcacagttccacatggctgcagaggcctcacaatcatggtggaaggcgaaggaggagcaaagtcatgtcttacatggcggcagacaagagagcgtgtgcaggggaactgccctttataaaaccatcagatcttctgagacttactcactatcatgaaaacagcatgggaaaacccacacccatgattcagttacctcccactgggtctctcccataacacatagggattatggaaactacaatttaagatgagatttgggtgggggcaaagccaaaccatatcagctgtctttgggattgaagtacagaacctaaatgtggcttccttgtgacttaaagtctaagcttaacgagcatggtgctaaatttcaggttggccagaagtgggatggggttttacagaagaggtcttctgggggaggtgaagggcagagtggagggaaacaggatgtggtaagaaagccacaagggagagcacttgttgcacatattcacagttcagtgtcttctaaattacccgccacaaagtctgcagtgtttggatgggcaggtgaactactgattttcaaccaaaaattgtttttctcattgttctttggagtgttaccagtaattactaattttgaatctataccaagcaaaccccagattcctgcctaaacacaatctggcctgccttcatacttcttgccattgtaaacagtagggatttgggaaagcctgaaatctagctgtaaatgtctaaaaatcttctggctagtatacaaagagtagccatgaccatctaatgatttcagtccctgactgggtttcaaaatagattttctgaccagttttaatttagtcttcatgaattgaatgtcttcctttttgagatactgtaacaaacagtaaaactaactgcagcagtacatttagaacactgaagtgtgatctgatacagtgaagaccttctgtagcatcatattgtgcaaaggaacatcctcctcagtggtgccagctttactgcaaaaggcaagctttgcacgttttgaaacagatgttcagatgtaaactgtagcacatgctttactttcctagggtaagtaacaaagaaccattactgggtagcttaaaacaacagagatttattctgtcaccgttgtggaggccggaagtctgaaatcaaggtgtcagtagagctattccctctctgaaggctctagggaagaacctgttctgtgcttagcttctggtgttgccggcaatcctttggtgttccttggctgtagctgcatcatttcaatttctgcctctgctatcacatgatggcattctgtctgtgtgtctatgtctctttcttagaaggacaccagtcatatcggcttagggttcaccctaattcattatgacctcatgttaacttgatacatttgcagagattgtatttctaaataaagtcacatccacaggtgttgggggctaagacttcaacatactttggagggggagagcacagttcaaccataatagcataccatgttttgatctttgagtgtattcctaaaattcattaaaattcctctttttctcttgtctaattttgatggctttggttttaagtatctttttttctcctttacagagaaaatgggctgggctttctattgggcaagaaatagaaggtaggtatattttttagccacctgataaagattttctatgtgattttctcacagttattgagatctgtacaattttctattactagtggtcagatcttaaacattcattgtatcagaagactggttacatctatgagaatgggaaggaaatagttatggtacctctgttcctatatcttttatgaagtgtgtgataaggtcgtcatagttcaaggcaaggaaagcaatttgtgacttccagttgggggcgtggcggggtggaaagactaagctgctaatagataataagccaaagaactaataagcaaaaagtggcattgtctcaggcaatgtggcaaagttaggaaatggagtatgagtcgtctttagtcagatgattttatgtcaacttcatggatacagtaggggaaggaaagaaaatgcaagtgtaattaaaccagcttttcttctgcttgtctttaaaacttaaaaaaaaattgtatttatagaaaggttgcaaaaataatacgaagaatttctgtatactgcctttacccagctttaccaattgtcatattttctttatcattctggctccctgtcttcctctctgggtctctgtctctctctgtacacacacacacacacacacacacacacacacacacacacacgcacacacacacacacacatcttttatcctactcctcatttaggaacctgacaacttgtaattttttctaagttagatggaatttaaacattggggttattttattttattttatttttgagatggagtctcgctctgttgccaggctggagtgcagtggcgcaatctcggctcactgcaacctctgcctccagggttcaagcgattctcctgcctcagccttgcaagtaactgggactacaagcacttgccaccacacccggctaatttttgtatttttagtagagatggggtttcaccatgttggccaggctggtctcgatctgttgacctcgtgatccacctgccttgacctcccagagtggtgggattacagatgtgagccaccacgcccagccaacattggtgttatttttagttagctttttctttgtggaagtatgaacacttgttaaatttaatgagaaagtggggtagtatgtagcttaggtttctaattttcataaattaatttttctaaatatgaggctaagagtacttaaaactttgaatctagatattttctattgtgacaagatacagaaattcaagattataaattttgatgagttgagaaatgtgttttgcggtttaagttataaaagcattcttctgctaacagaaatgcttatctggattgtaaagtcagatctttaaagaagtggctcaaacagacttaataagcaaaattgtaaaacccagtgataggtgggactaaagtggagtaagcttgagggaaggtagggttttggggcccaagtgatgtggatgatgtagccataaagatagaaaactggtttggtttaagtagtgatgtagaccaagataggataggaggtgtggtttgaaggagtgctcaagtattctggaatgggagttccgtaaggtgaaacattttagtcaaatcagtgattttagtctgagggaatcttctggaggaatcatttagtcggtcttctttccatctggcaatgccatattttaagtgttacaggctaatgttttgaccactatatatacacctattattgtaaagtccaagtttattcaaagaactggatacacttattttttgcttataaaatctttcttattagtcttttatattaaattactattagccgtaaaataagaaaacattctcaatcttctttgatccaggatgaaatcttcaggactcttgtccctttgggactgaccatggtgctgactgtggtgctgcctgggatactgtccatggtgctgcccatagcacttgaaattgtaacagtttggtcttttctatttaggaacattggccttaaattaaaatgcatttgaaaactacagtcagtgcattactgcagtcagtagtaattatatttttatttatttatttttgagatggaatctcgctctgtcgctgaggctggggtgcagtggcatgatctcagctccctgcaacctcctcctccccagttcaagcaattctgctgcctcagcctactgagtagctgggattagaggcatgtgccaccacatctggctaatttttgtatttttagtagagaaggggttttgccatgttggccaggctggtatcgaactcctgacctcaaatgatccacctacctcagccttccaaaatgctgggattacaggcatgagccaccacgcctggccaatattttaaatatacttattcaaatttctcagtatgaagatgacatgaatatatgtatatacacacatatatatgcattatgacattatgatattgttttggtgtctttaatgcacaaaatggtattatactgtacaaacctttctgcagtagacttttgtcactcaatattatgttttcaagggccatccacctttttttgagatggagttttgctcttgttgcccaggctggagtacagtggtgtgatcttggctcactacaacctctcctcccaggttcaagcaattctcctgcctcagccatctgagtagctgggattacaagcactcacccccacgctggctaatattttctatttttattagagatggggtttcaccatgttgaccaggctggtcttgaactcctgacctctggtgatccacccacctcagcctcccaaagtactgggattacaggtgtgagccaccacgcctggccaggccgtccatctttaataaatatacataaagttggtttttgtttttttgttttttttttgtttttttgacagggtctcacttggctggagtgcagtggtgcagtcgtggctcactgcagcctcagtacctggctaattttttaattttgtgtagagatagggtttcactgtgttgcccagtctggtctctaaatcttggacttaagtgatcttccctccttagcctcccaaagtgctgggattgcaggtgtgagccaccgtgcctggccaagttttaatttcaataaaaattgctgtaaagtattctacattatgaatatactacattttattcattgttctcctactgataaacatttttcaatgtttaagtactataaataatgctgcaatgaacctccctgtagatgtgttgttagacaaatgttctagcatctttctgggacagacatctagaaatggaattgctgaatcatcatattcatttttacattaatatttcaacctataaatgttttcaaactacatgagggaaacaactaagctcttttgcctatcaaagttactcagcatataacctgtactttctaggatttttttttttttttttttttgagacagagtttcactcttgttgcccaggctggagtgcaatggtgcgatcttggctcactgcagcctcgcctcccaggttcaagcgattctcctgcctcagcctcctgagtagctgggattacaggcatgcaccactgcacccggctaattttgtagtttttagtagagacggggtttctccacgtttgtcaggctggtctcgaactcccgacctcaggtgatccgcccaactcagcctcccaaagtgctgggattacaggcatgagccaccgtgcctggccattctaggaaatgttaagaaggagcaagccatccagaattggagacaggagagtattctgaaacttttagccaaaatttgaacttattatttgatcttcagtgagttttatgttccttcctcaggctttgttattttgcttttgaagtagttaaaatatgtatatgtccccctttaaatacagaaatctgattatacaaacaatttcatttaaagagtttacagaaaatcggccgttcgtggtggctcacgcctgtaatcccagcactttgggaggccaaggcaggcagatcacttgaggtcaggagttcgagaccagcctggccaacatagtgaaatcctgtctctactaaaaatacaaaaattcgctgggcatggtggtgtgcgtccgtaatcccagctacttgagaatctgaggcacgagaatcacttgaacccgggaggtggaggttgcggtgagttgagatcgtgccactgcactccagcctgggtgacagagcaagactctgtctcaaatataaaataagagtttacagaaaatccttgtacataactcaagggtctagaatttaagaaataagtttagaacagaatttagagtgtgaaacgaccataaagacttatctagttcagtcttgatttatagatgtgacaaatcaaggcacagacaacttaaattatttacttggattcttctgattgctagcagaatctgttgaaacacacatactcaaagtccctttgaagaaaacagctttgtttgtaaaccactagaatctttgcaacagacatttaatactgcacagtgacttcttttgtttacctcttgctatttgacctcagtaactcacagaaatgccatgcctgttgttcaaagcaagtgtgaaaaaacagtctttgtttataacctgcttttgtggtgagaactgtagaagctcacttacccaatgtgacttggactggtaattaagtgaaaagttggttaaaggctttttcttggaggtgtggtccatggattggagttctgtattatcttttgtgcatacactttacccataatttccaggtggatttctttgaaatggctggagaacttagactttgtagagcatctgagagtgccaaaacctcttggatttttgtagagttcactcccaaccttttctaattttaatgcttatacctagttagcagtattttttttttctagaagaaacacttcatttaaaaaattttcccaaagctttcaacttataatatctattctagaatgtcaaagtcattgtaataacagttcaacaaccaggccttcagaagtttttatactatttaattatatttcataattaactgtaacaagtgtaactagcacagacagataccagaatgaacttggttgacccatgatgtgtagcaactcctgtctacaagctctgagcgttaggcaaaccataggctgatgggtatatgttggagggataaaagttggtcagctttctgatgactcagctcagtggaggttgcttaagagagctgctactgtatccttaaggggccattggtaaattttaggacaagtatcttcagggaacctaaagggaaaataaatgtgtgtgtgtgtgtgtgtgtgtgtgtgtgtgtgtgtgtgtgtgtgtgtgctcgtgtgtgaagccttattgaagagtagcaatagactctttcttactaggcgtaatcaagttgccctcctggggaaactcaaatgcaaaaatcctcttgaacttttctgggtagcctactctactctttcctaatagtaccactacagtatacagcactgtaaaattttttgctttaaaagtttgtttataaactggcatttataagtatactttttgagctgatttaagaatcaagtttttttttctagggaaatgcttctttgtaattatctgtcactagcaaaatttgttttaacatatatttttctaaaaatatgatatgtaaactgtgttgtagttgtacaattaaaggtttttggtcgaacagttattacatgatgtaaaatcatgtgtaacactttaatattaattacattgtaacctaaaattcattttaaaactttttatgtggcttgaacaggaattttcttatccaaagctttgtatgtatgctttattgcctcctttgttattagcatggagaccatgggttttctgttattgttgtttcatttaaacagttcatgaatatattaagcacctgaaagaaactgttagatgctgttaataggaagaggagttaaaaacctcgtccttgcccttatctacatgtgtacatgtagaacttactgtagttccctagatgtagcaggtgctcaggaaacatttttgtagtagtaaaaaagaaatgtcaaactctaacttgctctggagcaaattccgctagtaaacattgtttttcaagcttcttttttttgccttgcgtcctactttcttaggccaaaataattcatccacatcccaccttagctgtttttttgtgtcaaacaaaaatcttatttggaaatagcatgttacgccaactgtgttggggcatcccatactgtattgcattaaatgaggagaaagatgcagaggccatgtggggaggattgtgatcctgataagagtgggatgagggataacaacagagagactgccgttcaatatttctttctttctttttttttgagacggagtctggctctgttgccctaggctggagtgcagtggcgtgatcttggctcactgcaagctccgcctgccaggttcacgccattctcctgcctcagcctcccaagaagctgggactacaggcgcccgccaccacgcccggctaattttttgtatttttagtagagacggggtttcactgtgttagccaggatggtctcaatctcctgacctcgtgatccgcccgcctcggcctcccagcgtgctgggattacaggagtgagccaccgcgcccggcctgccattcagtatttctaattaattcagatggggaagaaaatctctagtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctagtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccacctcggcctcccaaagtgctgggattacaggtgtgagccatcacgcctggccaaatgaggaatttaagatctaaagaaggtaaatggtatgcccatggctacacagctaagggacatagttgagataagaattaattaaacacatatttgatagtacctagtgcctagtaccagtcactgttttagacactgcagatcggcagtgaacaaaatagatatgatccctgctgtcatagaacttactttctagttgaagaaaacagaaaataagacaggaataccatgtacagttaggtctctgatgaaagtagatcaggacaattcaccagagagctattgcggtgctgttgtgtattggatgaccaaaattgtgctcagattgcctagctaaacttgatggtttttacctttgcttttagttttagtatcctaatagaaaatgtttaggagaatgtttaatagaaaatgctttggtatttataataatttaaaactcagtagcatgtagaagtcagtaaatccatgaaagagaatctttcgtaattcagagaagaagtaaatatcttactccagatcactgtccttaactgtttcttctcatttgtggtatctcgtagtagcagaatggacagacagcccaacctgtaatatttaccattataccccagcacatagaagaagaccaaacttttagaagggactcagcaaagatttggtgaatgagtaattgagcattcagaagctgtctctgcacttgtagggcaagcattttgtactagtgatagaaaagcaggaattgtagagtcacagacccagggttgacttctggcgctctcatttactgtgactttgagccttgttgcatagcctgtttctgcatctcagcttcctcactagtaaaatggagtcgtagtttctgcttccaagagtgtttgtgaatattatataactggctgtagtgtttgaataaaatactaagaaactttattctttgttagaaatagtaaatgtggtactcttgaattactttaggtggcactctgacatttaaattagatattttttatccatgtggaagaaattttaaacatgagttttgcagtcattttgtaaacactgatcgtaagtgctaattcccttttcttcattggctgtgagtagtttgtttgaggagcagattggagaggagtatataagataaactggttttctgcatttgaaaaacattggtgatgatctgaggatcaaactattatattatgaagtgatttttctccccttacctcttttctacatagcttgtctttagcttcaatgaaaagctttttggcttactggtgaaggacattgaagccatggatcctagcatcctgaagggagagcctgcgacagggaaaaggcagaaggtagcttttatttctgatcatctttactagatcatctttataatgtaatttgtgcagattgattataattttcctatctgttgcttagtgatttttttcatattgtgtacccttttaagatagtagggagaaaaaattgctttcatagccatcattgttattaaaatatagcttaaaatgtatttatttgcagacctaatattaatgtaaaatgtagacatatatgtacatataatttgcttgaatgcagatatttattgtaaataaataataagaaacgcattattggaaagatataggcatggaaataaggcatgtaagaattgtagaagaaagttatgagaaaagtaaaagtagctcagatgatagtctggaaggtttgctttgcccagagagacctcatttccccctcacttttggccttgctttgagaagtccagaagtttgctattagactactaattattgtctttctctacagattgaagtaggactggttgttggaaacagtcaagttgcatttgaaaaagcagaaaattcgtcacttaatcttattggtaagatttacagtttttagaagatttgaaatgaagtgggcctatttctatatgtaactcaactacagtgatttccaaatggggaaaggaaagaggggcatctctcttgagagagtttatcacagaagcatggggtatttcctgttggtcagtttgctgatgaaaacgtttaaaaccttcatctggatcaactttgtccaatagaaatagagtgtgagccacatgtgtaatttttaatttcctagaaattgcactaaaataagaaacaaattaattttttaacttttaattttgagataattttaggttcacagatttgcagaaatagctcagagaatttctgtatgccctttaccagcttaccctgatgttaatgtcttatttgacattttcaaaagtacaatgataagaaatgaacatggtttcatttctgctaactaaactacagattttattgagatttcaccagtttttccattgtgtccttttctgttccaagatctaatttaggatcccatattgcatttagttgttctgtcttttgagttttcttcagtcactgacagttcctcagactttgtcttttatgactttgagaactggtcagttattttgtagaatgcccctcacttggttttgtgttaaatgagatagcatcatcatttcttttagtgattaagtgatgaatgtgcaggtcaagtcttcccagcagattcatggttcagtcctactcttgtactctagcacaatttttgtcatattaaaacaattgcagcttattctctgagaatagtaactcaccagaataatgtgacattaactgggcattaattcttatttttggttgatttaactatgttgatgtctaccctactagagagtagagggttttcattggttgcacatcatcatgtccagggtcacttaacagtctttgagtgcgtggcctttatttcctggtccacaaattaccattcccccttattgttttttgttaattataaaatattttatttataaaatatggataggcattcgaaaacaattcacacactgtaaaatttggttctgttttcatagttttgtaatttgctttttttgcttagcatgtttcaaacatcttaaatatacacctataacatgatttttaatgcctgtatgtcattttatgaaggtaggatgtattttcctgttattgatctagtacatttatgaagtgatttctttgtattttatttttgtgtaccttttgttaagatatcccaagggagttgcataactttcataggtatttctaagtaatccatgggaaaaaaattgtgtagttaattggcattcagtaaattttgcccacaagagggcagtagagtgtaagaaaaaaatatttttcatcgctttccaaaggaaatcttaaggcctcaaaactctaaccataaaattatcatctagtataaacttttaaaaagcgttactttatttttaattgacagataataattgtatatatttatagggtacaatttgatattttaatacatgtatacattgtagaatgatcaaatcaggctaattaacatatcacctcaaatatttagcatttcttaggataaactttttttaatgtgacattttcttccctggttttataaaaaccatattattactttattttttgtttataatagagcatactaaggtacttaatttattctttgtttgaaatagtaaatgtggttctcttgagttgctttaggtggcactctgacatttaagttagataatttttgtcctcttgagaatttttaaacatgagttttgtaatcattgaagtctttaggatgatttcagacttttgtgtccaagtgaagagaaagcaaagaagacatcaaacttgttcagtatatttccttaggctgaggggttatatgcccaattacctgtataagcttaatctggataaatatatgtattttaaaataaacttgcgttaggagacttcagtgactgcgagatttcagttgcatttctgccagctagtgttgtcttcatcagatatggcatttcttctgatcaaccgagttagttaatttagttagattgaaggttaataaaactaagttttatggactgatacaaatagactacagcataagtttagctagtcattttgacagtgtgttaccatatatggagatcagacaaagtagatagcatagcaaaacttacccttctgactgtaaaatcagctaagattatattgttcgttttgtatatgtaagggtagcttttctttattcatttaggatgctcagggagttctgtctgtctttttagacttagtgataaagtccttgtttcacatttgataatattcgtttgacataggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggtaagtttaaaaaggaaaatgttataaaatcttgtgttgttaaaaaaattaatgcaatgaagaatctcttttcaatagttttgaaattatttttcagacccattatttttgtctttttctttaaaaatgaacagataaattttctgaaaaactttataataccagaacttttaaaattacattttaattttatggggaaatcatagaaataagacttgtggtggctccattttgtttatttatttattgaagaatgcttttctatggggcatatttagaaacttcccctgacagtaataatactagtagtgactccattttatttatttatttgcgtaagaatgtttttctatagggcatatttagaaagttcacctgactctaaagatcactatgggtcagatgtaccctgctgaataataactatctattaggctgtgtgcattgttctgacattagctgccgttcctttttattgtactgttgcattacccagttagtacatcttcatacctaataaatgggtacttgcatatttttaaattaaataagtttgatccaaaaagacaaatgcaggatatacattggagtttctatattgcatacaaagaagtgcactattcgtttaccactttcttcttgaaggtttatttaatttatctgtgtgaagtgactttatttgcccagtggaaatgctgtcatgactgttttcatgtccatatcattcgttggattggaatgtgagcaacagaatatctgagaaaggaatgtataacataacagcttctggcagactattagtgtaaaaacagcatccaaaaaaaatggaaggaatatgaatatattactccgctcatccccatcattctttatctttaaattgctactggaagataaaagtatatttattatagtggggataagaactgctttctaggcactaagtgcttggattgtattagccttctattgttggtagcctttctgcctggtcgctcactctgataaattacaggcacggcacacacctgttcactgagtaaaggtcgagtttggaattggattaagagaaaatgacagagaccctcatcacctgagttttatacaccttgaaatggcaatagcatactttttatctcaaagatacaaaggccacgtccattaaaagcagaattttaattgggaaaatattttaaaatgtggtagttcactatcttggtaatgtgtattttcgatcaagacatgaaaatattgtttaagtgtattttgggtaaaagcagggataaaaagatgattccaaatgttgtaagttattcttgtggaatgtttttactggttttcagaactgagatctagtgcaggaagagtctaatgattctgtttcttagaacatttatactgtttagccaaaaagtagaaaaataactgcattggtagtaagccgtctcttttaattataaatgttttctcactgtttggaagctattgaagataacagttattcagatactagtttgctatttgtgcattatctagatcctgcacttgaagctacgcgcaacgtcagtatgcgttgggtagataatgcgtaaaggagttggtctcacattggtcagtttgtgaccttgccagctgttggagagttttaaattaaatcagaacagatttggaatttgttagtgaatttcatctgtttctgatatccgtattgaaatgagctgaattacagtagtgtgctttttgttgtttttgatgtgttttttgactaagcactatggatttgaattttgtgagtgccactgtccagaaccttttttatggatttatttttctaatatttttacactaatttaattagacaaaaaatgaattctatccttttggaaaagttttttttttttttctctttatggctttttgccatcaggaagcatttgttaccaatttcattgaaaagacaaactagtataaagctgtcctggcttttgagctgaattgaaaaacttattttctttattctggatgaagtttctgggtatctaaaaaaaagtaaagcttcttcttttttttttttttaatggttaaatggctgagaaataattcttttgtaatgcatgtataattccctgtcttccaatagaggcttcttttttcctttgaattttgggggaattatatagtaaaatcctttcttgcactccaattacagtgtggttataaagttctccttaggctttggtaaaggtatataaataaaaatggttatattttgacagaatataaataaaattatacaaattatttttatgcatattctgtgttgttttttttttttgacatgtcaggtgggaacaacatggatttttttcccccactctttgttaactaaatagacagatctatatggtttggggattcagctggacactgagtatgactggttaaatcagttctaatttttaaaaaagattagaaaagaataatttatgtaggttatggggcttttttgttttaagcagaaaactttacttttggcttgagaccaaattactgtctttaccatggagtctaaagtgatgtctacttcgtaaacaggaatcttaactaagtggattttttgcctatatatcaattttcaaatttacaaagtgataaatttagaatattcttctcttctgtcattatgttcatcagactgataattatgcttctaggtaacagagttctttctttttgtctataaaacttcatgttgccttttcaaaattgaaaaatatagtttagctacgaacagaatgttgctgatgagatataggaggactaaaggacttaacgagaggcacacaattaagcagtaaaattagggaaccaatgaggtaatatacttgaaaataactgtcatggagtttccaatctgttagtttctctcttgaaggtctttcaaataggtagtgtataccttaggccgggtgcggtggctcactcctgtaatcccagcacttagggaagccgaggtgggcggatcatgaggtcaggagatcgagaccatcctggctaacacggtgaaaccctgtctctactaaaaacagaaaaaattagccgggcgtggtcgcgggcgcttgtagtcccggctcctcgggaggctgaggcaggaggatgtgtgaacccgggaggcggagcttgcagtgagccgagatcgcaccactgcactccagcctgggcgacagagcgagactccatctcaaaaaaaaaaaaaaaaaaaaaaaaaaaaaaaagaagaagataatgtatgcctttctgcttttgtacttttgttatatttttgtagaattaaaatcaaggaaacccttaaaggagaaaggaagtcacataaagctctctagactgagggataaaggaaaagggattatttaggggaatatcaatttagacttttgtttttgttattgttttaatcagagtaactgttgagttttccccttgtctgaagcagttgagctcacccaaacccaagtggggcagcccttccttggaaggatatgagagcaacgagcgaagaaaactaaacctataccttgcacttagtaaataccaaatagatatttagttagaatgccttccaaccccccacaaaacagatttttaattaagaattaccttaaatccataattttatgggctaatagaagccacatttgagtcccagggtagaaatgtgaacatcaaagctggtatctggaagtatgggtgaataaattcaacagctgattgctgtctttcagcatattcaggtgttaactgaatagatactgaatacttgtgttcggacatttaccacacttattcccctgtatgcagttttgtggacagtgttcaggataaataaatgattgattacctcagttctcactgtagctattttgttagcaaagatagcgtttctgccaagaaacttcattttttcagcatccctggcaattctctctaaattataaatgtcaaagcaaaaaaacacatcgttttcaatgaacagtggaataattgttaaagaattagtcagcatctcttaatgtaatcctgggaataggttcacatctacccaaggaaagacctagaaggaaaaggatgtaaagagggaagacctcagcctcacactgtctttcagtggatctgtggggtgtagatgttcaggccacctagtggggaggaaagccacttgttatggtcttgtgcccccattctttgaaactgacactgtgttctttttggtctcctttccccagtgtctccctctgtaagcccattttcaatcgtatttttaaggtttcttttgaaattcaagaggaaagcaactcttttctgatatcataagtgaaattgtagttactctatgaaacagaactgctgagaagataaggaacctttcaatcacacagacatctttcacatactaaaaacagtgcaaataaaacatagtggaagaaagggcactaaggttttgtgcatgccatattttggagagagggagttcttgctaagattaacataaacactgacactcttaaaatgcattttcacacccccactcatgaggagagattgcattttaaatgggggttaagacatccaggcgaactccagggctctgtaaaaggaaccctaaggctaaagagcttatctgaaatttgaaaaaaagaaaaaaaaatgaagccttctgacattcatctttttttcttgtattagtcataacttgcttttcagctatattttaggttttgaatgccaacctgacatctgttcaagtctgcctgtaatttattagcagaggaaaagacagcagttgctcactagttagagatgcaaaatttctgccttcctgttctccactaagtacttatagatgatacctggatacgaagaatgtaataatttactgaaaacttcaggtcaggaaatttataaagatttttttttaattagaagaataaaatggcttaagaccatgtgatttcaaaaatctctagatcaggatttagagacaaaacatagaccctaaaaaatactttagataactttctataaattgtaatttttttaaccttgaattaatttttccattggttttaaatttttaagttaaatgtatatttgaacagcagttgtgcttatatctgaaagtcaaactgtatgtaaattcacctggcattttgcatttatagacagactttaagaaacaaatcttttggagaggtagtgctgtctacagagtcaccaaatggattagatttcctggcaactacagttgagttacttacagatcaacagttgggtcactacaaagttgagatctaagtgttaacctgagtgcccaccagtaagaaaccggttagaggcaatcttaaaatgatatagctccaaatgtagagacatgtttgtgttaataaaaaatatataaaagcaaatgcattctaaaaatctctaaggacatacattaaattgaaaaaaggtttatggctgaatgtggtggctcacacctgtaatcctagcactttgggaggctgagatgggaggatcacttgagctcaggagttcaagaccagtctgggcagcatagtgagaccttgtctcatttatttatttttttaatttaaaaatttaatttaaaaattaaaaaaagtgtttacttccatggaagggaagctaagatggggaataaagggaaagttttgttcttttactcaattttacctttatgtctgaatgttttattgtatttctaatgtgtgattttaaaagccaacagacaaaagataatatcacagtatgtttcttggggtgactctaccatcagcatggaaagtcagcaggaaacaggtacatccttccgccttcatgaagttttctgtggaggaggagagtgcagggtaaaaggcctggattccaagggctttgctggcagccccttagagggtagacagaacacctatcctatttggtcaagaagagaaaaagtttctccatatataacaaactgctttcccccagaatgttctgcattatagtaatggtgtaagtagtctgcccttcaaacatgagaacatttgcatccaggcctttaggcagccaaggcagcattaaagaagaaagagtgggagcagagcaagctgagggagagcagagcttctgacatttgaggaactgggcgtgaatttgtttttagtcttcaaaaaccattctcttgaggaatcgaattcccatgactcctgaagtgaagcggttggtgttttctcctgcgttactcccatacgtaagttggtgattataatgagggtggtggctaatacttatataatgccagacgctgttctgtgtgctttattattgtgtttattaatcctcacaacaaccttcagaagtagacactgtattgtctccatattatggagcaggaatctctgtctcaaaaaggtgaagtaatgggtccaagacacacagctagtaagtagtagagtcagatttgaacccaggcagtcgagccccagatttcatttccttaaccattacatgttattctcccatgaaagcccatcgtgtaaaaccattttaatgggctttctagcttcacttttttggggacctttgaagcaatcattgaggcagcctttgttctagccaagggccaaccatggcaccattgagattttgagctgtataattatttggtctggggactgggtgtcctttgcattgtaaataactaacttttctagtaatctgatgtgttcaaattgtcatgagctcaagagacatgaagatttggtggtaggctgtaatacctaatgccacttttttcatgtgttttttgtcacgtgttgtagcagaatacaggaaggaaggaactggaatgggtgtgtcagagaagctgtcttaaactgtcaacctggagagggaacataaatgttaaaattaaataatcattaaaaaattaagcaacgtaacaagtgatatcaaaggccagtatttgattaagtgccagatgagcagtacaattgataagccctacaggaactgaaagggaatcacatcgagaagacttcatagaagaggcagagcttgagtaaggccttaaatgctgagcggttttggataggaggagggaaggggatagttgtccatatcctgggaagagtgacagactaaacacggtatagacttcatgacttagaccagtctaacagagctgttgtttggaagaaacaggaaataggattaaaaagttagttttgggttgggttgtggaaatctgtgaggagatgtggactctttttaaagtactgtccctgtttaagcttccagacagactcagaaccttccagacagactcaggtgcttctcctgtgtttccctgcaccttgtatatacttagaatccagctgtgttcttaatgtaattattcatttgcattacactcctaaggcagaatttcttaaccttggcactattgacattttaggctggataattcttagttgtagggcgcctgacctgtgcatcataggatgttaagcgccatccctggcctctacttgatgtcagtacttcccttcctcaccactccgagccccagtgacgattaaaagaaatgtgatgaaactgtcctgtgttgagaaccattgctcaaaggcctttgaaggcacaactgtaatgtcttcttatccatgtattatcaacatcaggggtgttgggatgtaggttgcaggtcattgttggaccatgaaccactgttaccagtccacaataagacaaatattggaaattaagaataagtaattacaaatgtttatagcaatttgacattatcacaatttttttaaaattatattttacaaaaatgttggtctgcaatggattggaaatttaaaaggaaaaaaaatacagctggaccttagcatacatagtttgagaagcactggcctatgtaaatatttgcaaaatgaatgaaattttttgaacagatgccttagagaaaaggtgaggcgaatagtcttagagaccagtagactattgctgtccagtgtgtggtacttagaatctggattggggtgaaggcaacaggaatggaatgggaagaaaatacatgaaaaaattgcagacatgaaactggcagaatttggcaatagttattgtgggtgacagaattggaggtgagactcaggtcttgtgagaaaatgttggaaatgagaaactcaggagaacatagttttggaaaagtagagaatatcattgcacatattttcaatatcgtgaaaggaaactggaagctgaactgaagagaggaagaattactggcatttcaatttattgaagcctagcttcaatcagtctgcacgtgtttaggaaacacactgttgactacttttgcttgaaataccctctttacttggcttttctcactccaagcatttctggttttccttttacctctctggctgtctcttttcaacctcttttgtgtcccttaaaatgttggggttcctcaggagtctgtctttgacctattatttttctctaattattctcctccaaattaatcacatctgtttcatagcttcaattagtatctttatgctgctaactctcaaatatgcatatgccacctcggtctcagtttagaactctggatttgtaccagcataatgtgttgggtatttcatgatcacatagtaagcttgaaattaaacacattcagttgccccctcagtcctctctaaacatgcatctatatctgtgttttctatctctggcaatactctagccaaaaatctggacacctttaactcctctctttccctcacctcccacttccagtaagtcgcagaatagaccgtcaattctgcaatctccgcaatctctctgaaatccctccagttctctctacctcgccctgccactcttccttcaggacaccattatctcttgcctgaattgctccataagccctcagccttgcccttctctaatccattctccacactgtaactggagtgatttttataaaaaggcaagtctgatcctgtcactgcactggttcaaactctttagcagcccgccttaactccttacatggtttacaagccctgtgtgatctggctcctgctaaactttcttgcttcgcctctcagcccgtgcccctcccccatactctgggttccagccagcctgtgctattttcagttcctctaatttgccatgctactttctcttacctctatatcctagggttatttttttttgctttttttttttcttaaccatcttttcatccaattcctgttcactcttcaggccaaagctttgaactcactgtttctagaatgagtaggctttaatgttcctcatgtgtgttctaatagctccatgttattttatgcattattacattgtattataattgcttattacatgtctgtattccaagtcctctctccatgtccctgccctcacaaacatagtataccttcagtaaggaataggccttgtttattttggtcactgtcgtattctctcctcccggcatggtgtctggcttataagttttcaggaaataaataaatgccaggaacttgattaatcttgattaattaaatagaacacttagacagtttgatccaagccctgccctcatgatacttacagtctgtgtgggagtaacactgtatttgcacatcccaaagcagtactgtgtaaaacataaggtgcattgtgaaccagattagcaaagtaggccacatggagaagcagcagatgcatttaaagagcaagactgagccatatctttaaaagtcaaagcagatatgatgtttataattcattactaaatccatgtagatcctcttagattctgaatttaggaaagacctcttggattggtcctgaatggcactaggctccagaaataagaaaaggaagagtattttcttgggtacttgtgagctaccatttgcttcattgggaactgccattcttatgtaagggcactataacaagagtgttcacatttaagggcatcaggtcaatattgcgtctgtgtgagtttgtgtgcatgtgaatgcacacatgtattttctatttttaaatagaaacacattataaaaataatgcatcctcataaaacagcacagatagagtaaaaagtgaaatctcccttcattctacccactccagttttactccctctcttagaggtagacactgtaaagagattggtatgaatttttcaaaccctttcctaagtatttatacaataatatataatcaatccattcattcatttattgagacagggtcttgctctgttgcccaggctggagtgcagtggtgcaatcatactccattgcagcctcgcactcctgggctcaagtagtcctcccacctccacctgccaagtagctgggactacacccagctaatttgtgtgtgtgtgtgtgtgtgtgtgtgtgtgtgtgtgtgtgtgtgtgtgtgtgtttgtgtagaattggagtctcactatgttgctcaggctggtctcagactcctggcctcaagcagtcctcccgcctcagcctcccaaaatgctgggataacaggcatcagccactgtgcctgacttttttttttttttcaacctagtagtgtatcttgggtttttttctgtgataaagcacacagataacattttattttttaaaaagttaaatagtattagcagatctgcatccacacaagtcccgtcatggtaagttagcgtctcttcctcagcagtaagaaggctcctaggcacacaccagaacaaggttggcattgcgtctcctttctactcacttgtatggccctaggcttctcaatgcggcagggccctgggcgctcagctacttgagccttggtacccttgcctgaaaaattgtttattggtaggtaacattaatgtgtgtaagttttctaacacagtacctggctgactgtcaaacactccatggatgatagttacttggtatgattatattgccaagaggcacttttggagctctgtaaaaggcaaaaatttataacccaatccctttaatctaatgttaagatgtgttttcttcttatcttaaattttgttgctgttgaaaatagttaacacctgagattttcctcctatgctgttttataattacccattttgaacagtgtttgttgataaggtagtcaaggggacacttcgaaatattttttctttatttgtgaagtcatactttggctgatttatatttaatttttatcacattacatcggagaggagcagataaattttctatcacctctataaattttctatcacatataagaaagtgtatcttatatgtgatacactaacttggaaaaacaacagctatcttgatagacacaatagagaataggatgtcagaggaagagaagaattagaatgttaacaataatgctagtaaaaagctacccaggacttaaatggtattatttgagagtacttctaccatgattcaaataagacttgccttggaattccatatgatttgttacttagagcagtctacctttaatatgtttaatatggtcatactttaaaaaaaaaaacctgcaagaaacttgggtttcacgtttttgctttttaaagaattaacataatgttatttcaggtttgtaaaggaagttacagaagatagcaataaatcccttccatataccattttagtcatagtgcaaaattaggcattgaaaattattatgggtactgtattagatattcaaagatttatttgtggctttgacttctttaccaacacctctggctttaatacagtatcttttatcagagcaagtaatagtttgaatccttttcttacaaatcctctttttactcaagtgactgcaaacttataaagatgcacacatctgtagcttgaacgtctatgctatttgctcaagtatttacttgaatttatcctcgatgatatgatttttttaagtgctttgattttaaattctatctagaatcccatcatgagggagaaatcttagcaagacttaagcaccttttcataatgactggttactgtaggataaacctataattagtatattgctaatccacacgttagatatatcccatcaaatttcaaatatacacaggagaattatccacattgaaggttattagtgcattccagggacatttccatgttgattcacaactacccctttaccttacactttcctgtgttactagacgtctctttctgtaaaacttctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaacccttttttttcatgttatctagaaatgaatctttaaaaaaaaaaaaaaggaatgggttgaacttataatattttagcaactcataaaataacttgaagaaaaagatcatttggaaggagagacaaaacagactgaaagacattgtttaaatttatgacttttattatcttacttgaatgctatttttgcccctctcgctattattaaaccctttgcttcctgttttcagttgctcctgtcaaggtatgaatttttctttggatgattgtcatctatttcatattatctagtattcctctctattatgagaaaatcaaaagtagacagtgtatctatagctatagatttaaatgcactaaggtaattatatatttgaatcagagacctaaggaataatctagtgtagcatttaccaaatttatttaaacttaacatgcttacatgaagacagacctatttatgtttccaaggaacaccagtttgagaaatgctgatcttacctgtgtcattcttattttgtagatgaggacattgggacctcagaagaataaggcaacttatttaggctaaagtcactgcttgtctactggggctggaatccaggttgcttagtctggtgccctttaggcttcatgattcagccacttaagacaatttgatttattgttgggctttttaattctagatttcataacttggatatgaaactgtacttcccagtctccaaaataagcttcactgttttctggaacgtgaattagattcagaaagccccttactgcctttagattattgcagcctccccagtgggccccagggatccaggaaaaatatctttgtttttcacctagtcctctcctcagcttttagagggactcttagatctatgtttatgaaaagacttttattagttcttatagttgtagtaatgcatgtttattgtagaaaatttcaaaaatgtagatgaataagaagaataaaacaatcactcagtgtaaaaaacaaaaaaccctgaaaaagtaccattaatattctggagtatatcatccagctagttttagctgtatatacatagagccaaaaaaaaaaaaaaaaagcattttgctgttttataactggttttctccccactcagtaagttaacagtttttcttaaatattctctacaacattctttattttgtagaatgataatgctgtggtttgtttaatcaatcccctctagttagaaattgtattcagttttttactattatacactatgtttaacaagcaccttagaaactaaatatttctacacattcatatttctttaagataaattcctggaagtagaattgctgaatcaaaaaggattcacaagtgtaaatgtttttgacatgcactgccaaatttagacttcctttttgaaaagtcaaatgttaaggagatcaaagcaatcactaagcaggtactctggaagagaaatagaaatataaaaaatataatggtttcatgagaaactaatagacaaggtttcaagagacttggagtctagttttggatttgtcattgaatggctgtgacttttgggtcttagtttcctcattataaaaatgggaagatagactagaaatagaaactttttcagaatagtcaccttatgaatgttgtttcagtgaaatataaaggtctgtacataagttctgcagggaagatgccatgtatttgctcattcttcaagtttcagcttgattgcctttggaaggtctgtcacacttaacgtcctcctaatagaagtaattgttttactttttggctcctcatagccctttttaaatgttggttctgtatagttgtatctttgatttttaatattgaggtatttgtaacagaggttatcttactcatctcctgaaagcacttggcttagcatagttcttgggtatataatagagactcagtaagtatctgtggaagttgagagtgataccttgttccccagtgtataacagcaaagcctagcctcctcctgttgagcattgtctgttctcgctttgaagagctcaccacatttcttcagtttgtttttgtttttattttattttattttattttttttttttttggcggggtggggtctttcctattcagtaacacagtggttctcagtctttggtgtgtatcagaatttttttttttttttagagttttgctctgttacccaggctggagtgcagtcgtgtgatctcagctcactgcaacctctgcctcccaggttcaagcgattcttgtgcctcagcctcccgagtagttgggattacaggcacatgccaccatgcctggctaatttttgtatttttagtagagacagggtttcatcatgttagccaggctgcccttgaactcctgaccttaagcgatccacccaccttttctggtattacaggtgtgagccaccctgcctggcccagaatttttaatgttaaaaaaaatacagatttccaggctctcaagtacactgaatgtgagtgtcaggcacaaagccgagacacagcgctgtcaatagctgagctctccttggggttttagctttgtcaggcaaattgatattcaagttccaggtctgccacttaccagatgtgtcttccccttaccaggggaaggtcactttaccactgtaagcctcagtacctcttccttaaaaagagggtaaaaataataccttagctcatagttttaaaaatgattacgtaagagaacatattaaaacacgtagtatagcccttcccatatctgcagttctggccttgatctgtaacttcttggatcttatatgcatttattatttatttgtttctttttaaaataacatttatattttttcaacttttagaggttaatatgttcattatagaaaactgaaaaacacaagaggcatataactaaaaaatcatccataacagaatcagtttacattctgatgtatctttccagtccttgtatgtgtatacatatatacataactgagtatacctttttacatggttacacttatatagtatgtgccatgctttcttgcatatcatgagtacttgagtatcaaaatactcagggctttaggattcagacattggtaaatattcacgatacattttcttatcttttgtggggacaaaaatatcttaaaaaacaaaatggcaacaggtctctggaaatgcatattggcaggtttatagttaaatactgtgttcacttaatacccaatataaaatgagatacaaagcagtcaagtaagtataatgcttcttagatagttcagtatgagatctgcactattaaaatattaccagaaatgatgtttctacttaattatttaacaattcatatagtattcacaaagtataccaaaaaaaaagcacacatatgtcagtggttataatcagattgtaaatatggacatatctatatatatctcttcccttacctttctttctgccccttccttagcaatccagtacgtactgatgtatactgctcataggtggtttaacattgccatttccaagatgcttcttttctaatgaaattaatttactatctagttaattcactagctctattttatacattgtcacctcataacatctagaaagcttagtgttgtgaagtaaggactgataaacagaggcactttactaaaaaatcacttcctagaactgtggctacaatatgaaactatcttctagatatgaacatacttgcaaagaaccttccttttgcctttcttcttccttcttcagctcaatgaataagtacagaaatgcatatagctctacgagatgggttaacaacagtcactcccagacaacaagccttgctaaaaactctaacaagaggacatttatcaaagaatcattttacttcttaaactttcagcatactttgggcacttctcagcattggggccttgtttgtcctttgcatactcaacaatgctaagtaaatgcacttgcagaacgacgagtagataatctgcatttatctcaaaacacactggcacagaactcttccaccgtcacttcctgtctctcccacctcctttactacccaatgagcaaagaatatgtagctcaaagagataaaagtttaacagttccattctaaagacagtcattcctgttaattgacataaacttacttaaagtgtgttattttgtgaagactacatgtttcaaacgtctactgtataatgatagcattgattaaattgtgtgcatataacaaaggctataatctgaaagtatcttcgaaatatgaatattatagccaagtacacttcaccttctcacttccttcttatcattatcagcccaaaggacaatatcagcgttccagaagttgttttcagaagatagtcttacctatgaagttttcgggcatacaagaaaagtatataatatgttttagttcatcatctcttcttttgtcaaacattagcaacctctttatcatctagacaacaagatgtaaaattaggacttgcttgttcattgtacagataaccctcaatgggttatgtctcagcaaacccatcgtaagttgaaaatatcctaagttgagagtgcatttttgacttacagtattttcagttgactatgggtttatcttgtcgtaactgattgtaaatcgaagagcattaccaaatgcatattgcttttataccatcataaagtaaaaaaaattgttaaaagtcaaaccagtttaagtcggggaccatgtgtatacactatgtgcacagcaaagtaaaataaaatgcacagaacatgcaggtaatcttgcctaactacaaacacatggtatagaaccctttattccttcctacacttcctttgccttcctcctccctcagtccacaagcacagatctgtaccactcaaagaggaggtctaataatcccatttccgaaagacagtatttcattaaatttattaattccttttatccaggcatttagtggtcatttttagatgacctttaccacatatcttcagatgctttcaccgtccgccataagaatttttactgaaatgaattcttgaaatgtttaaaactttgttacattctttctcgttccacaagtagttatcccttcccagttacctttcttttttaggtctgtggagtcatgatacatctatccccttttcctttgtttttcatgcatttgtcaaatttattattgaatactcctaaattttttctgcctttatcatttgttttttctttttcattgctttagtcagttacccttgcactacagcagtagcctctttattatcttccttgcctttagtcttcttcctttccatcctggaatatttatttcagagcttactgtacaaaaataccagattctatcagagaacattaaaggaatcacagaatctcagtattgcaaaggatcttagccatctagtgcacacacctgttttttatttgaatctcttctacatttctttttattattattattattattattattattatttttgagatggagtctcactctaatgcccaggctggagtgcagtggtatgatcttggctcaccgcaacctctgcccccctggttcaagagattctcctgcctcagcctcccaagtagctaggattacaggcgtgcaccaccatgcctagctaattttttgtttgtttgattgtttgtttgtttgttttgagatggagtctggctctgtcgcccaggccggagtgcagtggcatgatctcggctcactgcaagctccgcctcccgggttcacgccattctcctgcttcagcctccctagtagctgggactacaggcgcccgccactatgcctggctaattttttgtatttttagtagagacggggtttcactgtattagccaggatggttttgatctcctgaccttgtgatccgcccgccttggcctcccaaagtgttgggattacaggcatgagccaccgtgcctggccttttgtatttttagtagagatgaggtttcaccatgttgcccaggctggtctcgaactcctgaggtcaggtgatccacccgcctcggcctcccaaagtgttgggattacaggcgtgagccaccgtgcctagccttttgtatttttagtagagacgaggtttcaccacgttgcccaggctggtctcgaactcctgacgtcaggcgatgcacccgcttcggcctcccaaagtgctgggattactcatgcctggccctcttctgcatttctgctgagtaacttctgccaggttccttaggctaagcttaagttcctccagtgacaggaatctcactccctcctaaggctacattcctcttttggacaactataggtttaagtttagtcttccttatgttaaggtaagatgtatttgcttgtatcttctcctacaagctctggttcttcccctgaaactacacagaacaagcatgatactacttctttatgaacactctttaggtatgaagaaagctattgtccagacttccctgcagattcctcttttctctaagctaattctcctaagcttggttggttttttctagccagtctttttagccctttaccatcctattcacgtttctgtgaactttaacatttatgtatattaatgttaagctgtgaaacctagaatttagtggagtaatgcaaatgtggtctctgttgtaaaatagatcagaactatttattctttatttaaaacactagtcctttaatgtaggccgaaattgtgctaacatttttgacatcgacattctatcttaatgcttatctaatttactaatgaatgaaattcccagtcatctctcacaaaactgtatctcccccagctgtactcaagtacagaaaacatctattcttgataacttttatcttgttagaatagctcttttctcttctatagctacaacttgtcagtgtgtccttatcagcttatgatttaattgaggctatagaacatatacacttaaaaaaaataagctaagaactcttagaataaaacaacataatgtattgtcagttgtaaccatgaatgatgtttttcaaagtgtgtcctctggcctacattagagttacttagggcgcttgttaaatattcagtttcactccagacttaatgaattcagatttctaggagtgatgtctggaaatctgcattttaacaagctccattggacattggtgcatattaaaggttgacagctgctactctaagtactgaaggattgagcccaaagatatgatcagaattaggtggcattaataaaggaggtgatttctggggacagaagaacatgaactgttagagtaggtagaaattccaggtgtagtaaagaagaaataaattgtctgctagggaagatatttgctaggctgaattaggggcccaatagaacagcacataaaaggagttaaaagctaagggacggaaggaaaaaaaacaaagaaagaaaaaactataaaattctgaaaccagtaaagatacatgctgccatttggcagcaaggcagacctgctatagaagaagcatgatctttgtcatcaagaattcatgaaataccaggcaacaccctatgagggaatgtaaaagggtgggggtgtcagcaaagattagtttggagcattgctacacacatctcatctttagttctaggctatctaatgagaaaatctatattaaatctaagttgactgatttggatatagaccagtcggatggtagacagcttgcacagctgcttggtgctcaggaaataggctgttttcactagcatagcaaaactcagagtgctcttggcattttgaagttggtgggacaacagcaagtctctaccagacagaatagtgccacgaaaatggatggtcaaagtcccgactgcccagatggtatcaggagtagtggtcttggtcttaagtatttccatttcttaaagatttcataagtgcacagataaacaagtgtagatgacaacctattttagatgttgattgagagtcttaaggccaggcgtggtggctcacacctgtaatcccagcactttggaggtcgaggaggctgatcacttgagcccaggagtttgagaccagcctgggcaacatggtgaaaccccatctctacaaaagaatacaaaatcagccaggcatggtggcatgcacctgtgatcccagctactcgggaggctgaggcggcaggatggcttgagcctgggaaatggagattgcagtgagctgagatagtgccactgccctccaaagcctgggcaacagagtgagaccctgtctcaaaaaaaaaaaaggtttttgaaacaaaaggccctcctatataatgagtcaatgaaagttatgctcttagagtaaataattatattgtactactgaaatggtaagtcaagtagaactaagaaaatactcatgactctagttccaatttacaattttcaacagaaccataagagaagttgtaattatggaaacttaaatgatcaaatattaatttgtgtccaggcgcagtggttcacacctgtaatcccagcactttgggaggctgaaatgggtggatcacctaaggtcaggagttcaagactagcctggccaacatggtgaaaccccatctctactaaaaatacaaaaattagctgggcatggtggcacctgtaatcccagctactcaggaggctgaggcaggagaattgctagaacctgggagacggaggttgcagtgagccgagattgtgccactgcactccagcctgagcaagactctgtctgaaaaaaatataataataataattatgattatatttaaaagatcaaatattaatttgtgattatattttctacaagggcatgcactatttaaaattgagcactcaaatctggtttgcacaactgcacagagaagcttgcaagactgccgaatatgtcctgacttgctactagtcttttgatagcctccttctttggcaaacatggctagtctgcatttgtactggaagccacttgggattcctctttaaacatcagtcattgttcaaaacccacttcgcacttctttctctctttatagatcatgttgcccccaaaatgaactgaacactcttatcttaatgctaatttgacagagaccacttctaatttattatcatcctgcttactcttatataaaattagtgtttgctatagttttttctccctttgaatacctcaaagttgactgacagtttttcctcaacgcagcttccctctgataacatccagaaaaaatgaagaaaatatactgctttgtaaaatagaagagcttaacaagtacaaatttgtcacttttttcgggtgtttcgaaagagtgtaaacagtaaacattgctgtttatttcttgtgtttcagaagtaaggctatgtatttttatcgagctatttacaatttacatataagatgtaagtattttcatgaatcattttcatcagtggggtggatatacctatcatagtggatacggtcctattctgacttttagatcagaaatcactttcagttatttgtagcacacaccttaaagcctattaaagttctccccaccaaaatttgtattattataatcactggatgtcaacacctgtggctcaaacagtatccaaattttgtatattgttggaggattgctgatttaactgagagttgtagctagaaataaggtgagaaagaatatacaggtaatactaatccacctcaaactaagaagcaaaggatggtggatgggctatgttgatctagcgttgcaaaaacacttttggatgaagtgcccagaaatagccccagttcctttcactagaatcagcttgtcccaggtgaatgccggcagagcagggtgtgtgctccccaagaaagggcagtgaccgctttccaatgtctggcagttaggggcgatgagagtagttgcaattggcaagataaaggggaactttggaaaataaatatacttatgatagaggaggcaggagaaaaggtcaagggctgtacacatgtggaactgataatcatggtagcttggcttctatgaatgggtacatgttgacccttaagtgagcttagaaagcttgagaaatcagtatgcgtgaactgtttgaggcataagaaaggcaggattttaaaactttttttttaatttgtgcaaatttatgggatacatgagaaattttttacatgtatgtaatatgtagtgatcaagtcatggtattcaagggatctgtcaccccagtacaatatattcttattaagtatagtcatcctaccctgctatcaaacattgaatttattcctcctatcttactgtacgtttgtacctttagcctacttctccttagcctcccttcatccccagtcaccctccccagtctctgttgtctacttttccactctctacctccatgtgttcaaattttttacctcctacatatacgtgagaacatctgatttttgtatttttgtgtttggcttatttcatgtaagataatgatctccacttccatccatgtagctgcaaatgacataatttcattgtttttatggatgaattgtattccattgtgtagaagcaggcagaattgactctgatagtagtctagctggaagagaggctatagctacaaagaatcttgacttaccaaaacactagtaacatgtctgtgaaactgctgtagtctaactcatttactactatgttaatttggagcgtgaagttcatcagtggaatgggtactataatttgcgaagttcaagtgacaattctggtagataaagtttcaaggagcagatggtcacaactgtcagtctcagaagtaatttggtaagtaaaatagtcatttatttggaagttttttggtaacctaattgtgatctaattgtcaccagttgggagtctaattccattttcatcactcatctgcagaaaggtgagagaaataagctattaattaatagccaatatttacgagctcttactatccaccataaagtatgctaagtgctttatgtgcattatacttaattatagtaactttctgaggtagttactattattatttccagctagttagtggaagaaccaggatttgaatccaggcaaactgactgcagagccctcacttttaacactacacataaaactgagtttatttaacagaaaacactgtcctttaacctgagattgtgtctacctttcaatactaaaatgtactttttatatgaaatggtggtgatagatgatgtcaggtttgattttcttttttttttttttttttaagaaatctttaccttgcaaaactaaaactaaaacaacccaatgacagcactgctctccagtttaaagaaaacaaacgttcttttgctagttgtgaaatctaaatttgagaaccactgactagaaaagtgggactcttagtaatttttaaagttctttagagatttttcacctgatttattttctgatttcaacctccttgttttcattaaccttttccttaagtccacctcagccactcattcttcgattatacacaagactttgtttgccattaccagcaaccacaccactttggggatctcagatgtaagcatcttgctctcgcgctgcctcccatttttccttgcttactcctagcatttctcctgttaccaactccagcaacttggaccccactggaacctccagtataatttattctatcagttcccaatctttttgttctctctctcctctttccccagcttaacctccatggtctatcacatatatcctctttgtatacacccttagcagccttgctcctcatcttctgttgtcaaatccacaagtgtttctcagctacctgcctactctgtgccagtattctcgctgttaagcatggcttaagaaaaacacaaaaccacagtgtctgatctcactttaaatttatgaaccaaatctcaagtgagccctcagtatttcttggaacagatattcctagtattccttctgtatttccctagtccaatccatttattctcctattctctgagatgactagttcttcttctctatttggctcaacccccaagcaccacctcttccatctttaccagcagctgatgacctggaatctttacttcacggaggaaatagaggcaaacagaagagaacttcttcatcttcttcatcttcccaccacaagatgtatgattggttgaatgagagaaagactgtgatgtcctagaacttcagttgctcctatatccaatgtaattagcaacttaaattccaaaaccatatataaaaatcgatttttggccatttgagattatactctttactaccactttcctttctcttattataaccaagagttgttactatgtttgtgcctcatccaaataaaaagtaggtattttttagaaaatgattaacgggagcaattagtaaaacaagcagtaaaatacccggatacaggaaattgagccaggcttgctggtatgtgcttgtcccagctactcgggaggctgagttggaaggatcgcttgagcccaggagttccaggttatagtgagctgtgtcacaccactgaactctggcctgagtgacagagtgaaaccctgtttctaaaaaagtacttgacataggatattgagagaagaaatgctttggaactatgtttgattatacccttagcccaccttagttcttacttaagtaagttatagatgaaggagaaaagatgggaatcactttgaagattaaggcctcaaactttgtggaaaatggaggaaaaaatgttgaaaacagtcatgtgatagtttttaccttacacttttgatgggaaaattagataatagaattgagctatacgtatgttgactgcacattacattaatttaatcctgttatttacctcatattgctaacctttaaaattaagatttgaaaaaaaagagatgggtaaaaccaaaaaggtcaaaatttgtatgccagcttagatgaaatttgtatttatagaactgaataagaatctacaccttacctaatactgtgaattgcttatgtaaatacaacaaaggatggtccctcgatgacctgaatctcatatgctgagttcacttagtaacagcgtccgtctgctcagacacattttcccaactccccatgtgctttccaaacctttaccatgtttcccagtatcctctcttcatccctcattttgttgatgacctagttcctgcttcacatagtcaacagaacccaacaggaataacctcagctttcttcctccttgtccctttatttaactggtctcagaaggagaggtgtctttacaagctctccctctccattcctcctctgttgccaaagttcctgaaagtgtggtctccatatctgcttatgctacttagttttcttctaagtgaaaggtagggactcaaccccaaatgctctgaccctgttcgaagaccctgtggcctagagcggcatgtatttcctgatttctaaacctagtgccctttttccaggcctcatcctctatcactgcagcatttatctctgttgtcacattcttctgcttaaaacttttcacagcttttcacgtacccagggcaggcattcaaaaatattgaagcagtagttttgatgtcttttctgagctttcaccagtatttttaataggcactactgcctaaatgtcaaatgccttatagccaaaaacaagtaatgatttcctgtaatctccaaactgattcctcttcctcttgctatgtcttggtatccctgaggttaccatcattttatccatgtacccatgctagatgcctcaaggtcatccttgactcctcttccttctctggtttccatttggtttctaagctttgatgagtatctcccgcatcttcttttctttttctactatttcctatgactcttgcctctttctgtttattgtcttttgtctggattatttcagtaatatgttcaggagtttctaatttggattccatggatggacctcaaaggattaaagaactctctcaaatttgtatgcaaattttttgtgcatgtgcattttcctggggaggtccattagactgttctgtgggaaagagaggaatagaatgagagacaatgacaatttaaatcaggtccactgatttctcgttctatacctggcctttgttatttaggtcactaacctaaggcacttatctctgaggagtgaggtggcatgtaagatattaagaataaaacagcagcattagtcagtccagctgggcagtcagtccagcagccagagatcagaggctcctcaatatcagatccaggctttaatatcctagagaagctcaggagaaagctggggcatcagcaggagcagagggtgtcctcccgaggcccctggacccatttgttcctgtgcttccaaaggacttagagggatatgaaaacttaactggcaagaatccagagtgagttggtatccccagaaaaaggttcagaacattcccccagctagcctcccctcctttgcctgtttggtctctcgttctttctccactctgccaacacagttagcttttaaatacatatctcctggtgtgccttccgtgattgtcacttacacctaagggtgattagactaatcacccaaaaatgtggggttttaatcacctatgaaacaagttaaaaaatcatggtcatggtttcaaggcctgccagttaggagcctgccagtctcgtcgccaggcactgccctctcctcacttccagggctctggctacagcaggttactactggctgtttcgagagaacagtgtctgtgtccatatccctatgcctttgatcatgctagtctctctctttggggtggcatttcctctccattgcctgtgaacctcctactcattcttccaggcccacaatggatgttagctcttcacctgagtccattcttaattttctgccatcactctggcagaatcagtatctcttggctagagtccaaaaacatttcatacatatctctgataatgtcatattatattgtagatagcctatttttatttctgtctttcctactaagccagaaatgccctacagctagggactgtctttttcatgtttgtatccctaacagctacctttgcatctagtctaaacatgagcttagtacacttttgttgaatggaattagttataaagagtttttatgactcatttaaaattagagaccaatgcttacttaataagtcagaataggctgtaataataatagtaataataaagtcccatttccactgcttattcaagtaacagcttcctttgtggaagtacattttgaaagacttcacatgtcagtgtatatttttgatgtgctcatttgagatcctaaaagaattatagttctaaagcagactagagcttctattacattcctgttgaagttatattaaatatattctatcgtttcacatatctgtattatatataataagttgcatgggtaaacattttatctcttttaaacttcatggtaataatttgtgaattgtttattttataatatctgagtaaatttagttcaaaacacattaatttgagcattttctgtgtacagaagcatagttgcaaagttaagattcttgtgtttatgttgttttgttaaattcggaaagtctcagtcttgcaaatgtattttttttttaagtatttaaattagctcagctatgagaataagcacggtccataaattaagagcttcaaataattttttaaaatccttcatattctttgagttttgtaggaaaagaatcaacagtttacttattcagcctttcctgaagtccatagtaggtgctgggcatcatgctgggtgaatgagatagtacttgcatttgaatagtttacagtcttatagcgaagaagccatgtaaacagagaattgcaatataaaccttggaggagaggaaggaagactactttgagaaccgagattaggttgagaatggatgagtctgctgatcaatttatagataaagaagcagagaggtgaagtctttttttttttttttttttgatatgtgaaataggaacctaggttatctctaagaattcatagcagggggtagctcttgagaagaacagtgaagatctggataattaataaggagaattagagatgagctaacaaagacaagtaaagagtggcatgagaaagcagtgagcatagaactgaaactggatagcatgaaattctggaggtatcagtcagtagcacagtggtataattttctccagctgtgctatggagaaattatacacattgtggccaatgtgtagtgaataaagccatattgtattcagggactatggggtggttataacagaaatttacaaagaataaatagttaaaagtccttcaaagaaagcatggcttactagggaaggcagtatggttaagaggaagttgataaacttggagaaaatgtagaagtcaagaagttggagatcagaagggctggtgctttgtaggaactcagaaaatcttcattttcttctttctggatgtcctctccctatgaatgtttcaccaccaccacctgcctcagctacagtttatacatatgaatagtttcaaatcatgatggtaacagttggctcagagggcaagattaggagccagacttcaacgtgctgctaatccagcgtgtccctgtaacttagatgctggtagtgcttggtggtattggcctctaggagaagctcaaggcttctcctgttatctccctaccactcatacttggagggtgagtcaaaggccaaaaagcattttattgggcagtggttcttagggaagggatttactctgtgatgcagagggttaagactgtaagccatcaagtgtttcccctccctctccatgttcaaccaaaggcacagttcttattactttcaaggatttaaaaaggagtcttttctcagcataaaggaggaagtgaagaccaattttgacagcccaaagggtcttcctcctcagaatctaaaatttctaatagagttgtttgcatcttgtgattttacttgagtcatcaaatgtattgtactttttttcttaaagatatacttcttaatgctttcatttcagataaggacaaaccattttccatggcgacacactatttatattgcattttcagaaatttccctttttacccatacttaggagtgtgacactgaaacctgataatctattatttcacagagtgcttttttgggtgtaatataaagatattatataattttaataacctttgaggtacaagtggtttttggttacatggatgaattatatagtagtgaagtctgagattttagtgcaggacccattgtccaagtagtgtaaactgtacccaatattagttttttattcctcactcccctctcactttccccacttcttaattttctgccatcacaatgtgttgcccaggctggtttcatgccctcactttccccacttctgagtttccaaagtctattactctgtacacctttgtgtacccataacttacctccctcttgtaagtgaaaacatatggtatttgattttccattcttgagttacttcacttagaaaaatggcctccagctccatccatgttgtagcaaaagatgtgacttcgttctttgttatggctgaatagtattccatgggatatgtgtgtgtgtgtgtgtgtgtgtgtgtgtgtgtgtgtgtgtgtatacacatatatgatatataataattatatataatttatcgttatatgtaaaacaaagcaaattttttatttttatagagacagggtcacaaagtattgcccaggctggtttcatgctcctgggctcaagtgagccaccacacccagccaaaaataagtaatatttcccagttagacattttcagagtaaaaagtatttgttcaaaatcatagcatgaatggactcttccagagacctttaactggcagcatttccccctcaaactttagtacagttataggaattgtttctggatttttggctgtatattcttgttcatggctcatggacattaacatatgtgaatggcatcactgtgtttttcctaaagtgcatacgaagaagaaagaacactttcctttagagtcttacttagattctagttagctgatataagactgttttcttttccttttcaggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggagggtaatgtgaacataagtgtgatttagtaaaagtttatcactcgctatacgatgaatgagacccagagttatggagacaaacttgttgctttgatttatattttgaagcaacttacaggtaaatttacctagtacctaggttatatatggcactgcaccagggactgtggaagatttacgtgatgagcagatgttgttgcccacatattcctataaacaaaggtaggtgattgtgtaagccagaggttttgcaaaaataggtcatgaatatattttcaggtgacacttttattccatattgcttccagagacttgtgctcatttatcctttggaagaaaaggggaaattaaatccataaatagacttatgaaatcgtattatgtaaggttcatatgcaaaaagctatcttacttaacactgagtcttgctcagttatagagtgacaggattgagttgtcagagctcaaaggaaagcttgatttgcgtctcagaaatgaaattatttaaaaatcaagctagaatttactaattctgatagttttacatgtcaacttgactaggacataaagtgcctaaatatttggtaaaacatttcggttgtgtctgtgaggatgtttctggatgaaattagcgtttgagttgatagactgaataaagcagattgccctccctaatgtgggcaggccccattcaatcagtttaaggcctgaacagaacaaaaaggcttactttcctgcaagtaagagggaatttcgacttgcctggttgccctgagttgggacattggtttggatgcacaccgaaacatcagctcttcctggcttggaggcctttgggctggaactaaataatgcgtattagctctcctgggtcaccaggttgctgacagcagatcttgggacttgtcagcctctgaaattgtagatttatcccaaggaattggctaaaacgattatggaggctgacatatatatgtgggtgtatatgcatacatacatattcatagagatttatcataaggaaaacacacacacacacacacacacacacacgaacattctattggttctgtttgtctgttctgattaattatcctaatactaacatatttttttcattgacagtttaagaacaatgccatgagatttctggttctagcaatacagtagactaggtaaccagaaaaccttccttctataaacaccttcaaatgctaggtatacactgtaccccttaaatatgcacagttatgtgccaattaaacacaaaataaaacttttaaaagttctgggtaaaacataactgaaatcattttaaatgcataattgagctcttcagaaagaaaactggatctccaggaaattagagtcgtaagatacgggctgcagcttttggtttcataatatatgggtttgggttttagtacccactagggaacagaacatgagtccttgaatccatttacagtgtggactaggaactggtaccttcaaaggggttgtgtctatgaaaagagtggactagaaaatatctgctgctaccacagggaaattaacaaaaaatatttaactgcctgggttctggaatggaagctgggaaatctcctatgggaattcttcttcttctttttttttttttttttttttttttttgagatggagttttgctcttgttgcccaggctggagtgcaatggcgtgatctcggctcaccacaacctccgcctcccaggttcaagcaattctcctgcctcagcctccccagtagctgggattacaggcatgcaccaccacgcccagctaattttgtatttttactagagatggagtttctccatgttggtcaggctggtctcgagctcccaacctcaggtgatctgcccgccttggcctcccaaagtgctgagattataggcgtgacccaccgtgcccggcctcccatgggaattgtaaaccatggatccttgttcatgctggtttagaatttgaatgaatgtatgctacctatgtggcttgaaacccgaagctgagaaattagttaaaaaaattattcaggtgcagtggctcatgcctgtagtctcagctacttggaaggctgagatggaagggtcactagaacccaggagttctaggctgcagtgagctctcattgtgccattgcactccaacctgggtgacagtgcaagaccctatgttaaggaagaaaaaaattagtcctgggctagtgatagcataagttgtcagatataagcaaaccccagggggtgctccaacaacctaggctgaaaggaatagaaaaagtagtcatgaaaatttaaaactcagcaaccaagtttaagataagacaacaaatttcagctgaagagagaagtggtaaacagaagaataaacctaaagaaatcacccagaatgtagcacagagagataaagggatggagaagatgaaagttgagatgagagagttaaaacaagaagtccagatagaatagtgtagaggcattattcaaaaagagaatgactaagaatattctagaattaataaagacataagtactcagattcaggtagcaccatgagcctatatgggataaatgaaaattaacttatttctagacttgttataggagaatgccaaagaaaaaaaatcttagtaacaaaagaaagacatggagatgacttacaaaggggtatccattatgttgatagcaaacttttccatgacagaaagagagaacaaaaaacagtagaataatatcttcagagagctaagtgaaaataactgtcaacttaaaagttaatacccagcttaattctcattcaggaatgagggtgaaataaagactttttttcttcaggcaaaggataatagaattaactagttgcagaagcttgttggaagattatgaagcaagatgtactgagactgaaggaagttgaacccagaaggaaacagtagagccaagaaacaatgatgagcaatgaaattggtgaaaatatagataaagtctgggagttctacttctagtagtggcaaattaggtcatttgagtcatgtgttccactgaagactaccagaaaagctcaacacaatatttaaacatgttttgcttgaaggtatcaaagaagaaaaatggaggcctagaacaaaggtcctcctggtatactgggtcactgttcctctcgagatattagccagttctgcaggaagctgctaaaacctaagcagcccttttgacaggctagtgggagtaatgggggcagagattagtgcccatggcccctaaggaggggacacctgatgaacataactcattttgagtcaagaccctgaagggctacaccataggagcaagggttaaccaggagtagacatactctcactggggctgcagatcagctttgaatcatgtcagtccctaaaattagattgagggttcctaaattgctagtgcccctaggcatctggcagaattgtaaatccttcctggaagaaagtggtatcatgtaaggtcacaaattgtttctagtttgcaaatgcaatgtctggcttataatcaaaagcaactggaaacagatacacaaacaacatcaagaaaaagaaaagatggttcaaacagcctctagatattggaattctcagatacagacttttgaaataattatacttaccacattcaaggggataaaagacaagacagatttttggcagagaactggaaactaaaaataaacaaatataaattctagaactgagaaaatcagtaagtaaaattaactcaagtgaatgagtttaaatagcaggttagacacatctgaagagagaattagtgtactgaaagatataagatgaaaataaccagagacaaagaatgaaaggaattaagagagagtaagagagagagagagagaataccgtttaaaggtctggtgcgtgtatttaaagttccagaaaggcaagagaaagaggatgaatcaaaatcaggatttgaagagaaaatggtttagaactttctaaaactgatggaaaacattagtccataaattgcagaaatgatatgaaccctgagcaggagaaataccaaagaactctacatatataggcattattgttaaattgctgaaaaccaaaaatgagaaaaatcttaaaaggagctagagagcaaaggaaaattaccttcaaataagcaacaactagctagtagctgtcttctcaatagaaatgatggaaacaaaaagtcaatcaaaggccatttttaaagagctgaaagaaaataactgtcaacttagaattttatatccagtaaatggatgaatgatcatagaaatatataatggaatacaaggcagtaatgaaaataaatagcctacagctatatacagttgtgaatctcacaaataaattattgagcaaaagaaaccagatttcaaaaagaacacatactgtgtgattccatttatagagagcttacctaaagtatagtgtttaacaacacatgcttgggtggtaaaactataaaggaaaatgaattattaccataaaaatcagattgtggttacctatggggaaaggtcagggaggagtgcttgggaggggttgtgaggaggtgctcccaggatgctagcagtattctgtttcttatgattacgtaggcgttcattttgtgacagttcattgaggcatatattcacattttgtaacttttctctatgtgtgatgtattttgcaattaaaagttttaaaaataaattttaatagcattcactgagaaaaacaataatgatatgaatatttttaaaggatagaactaaaatatggaaaaaaacgtttgggaagtagattaaattcatgtaagctccttatattattggggaagatggtagggagtttgagaccagcctggtcaacatggtgtaaccccatctctactaaaaaaatacaaaaattagttgggcttggtggcgcacagctgtaatcccagctactcaggaggctgaggcaggagaattgcttgaacccgggaggcggagattgcagtgagccaagatcgtgccactggattccagcctgggtaacaaaagtgaaactccatgtcaaaaaaaaaaaaagaagccaataatgttagttaacattaagtcaaatgtgcatgtgaaagttgtacattgtgcccaaacttttccaaagcatagggaggagctgggaaagaaacaatggaaactcaaatactttagaaggcaagaaagaaataacaagactcaaagacaatgtgatgataataaaaaggtaattttaaaaacaatttcatttatagcagaaatcagaatgtaaagtgcctaggattcgatctagcaggaaatgtgcaagacctttaaggagaaaattctaaacatttttgaaaatctttttttaagcagctaataaatggtaagatataacatgttcatgtatgggagaactgacaatgtcataaaaatgagttctgcccatcttggtctgtaagttgagtgtatttccagtgaagcctaataggaattttttaacatttgacaacttgattctaattttttttgaggcttgaagagttatgagaattttgaagaataatgaagatttacttttatcacatatcaagacttactagaaagcaatagtaattgaaacaatgttatatattcatgtaaaaacagaccaaggaaacaatagaacacaggaaggaagagcctgctctatgacaagtgatgatacagatcagaggggagtaataggctggctgtgccttaaacggagctgagataattgactacctatttggaaaaagataaaatgcaattcctacctcacagcatacaaaattgcaaatggatttacaaaaaaacaaaaacataaaagcctactaaaatttataggaggaaaacttatttagaagaaaaataggcaaaaatgttttaagatttgaggctagggaagaattgatacagaaagtaaatccattggaagtgttaatttggctacattaatataaagaaaattctgtatgacaaattacactgaatacaaatgtctcaaactgggagaagatatttgcagtgtatataatctacaaagaattggcatcctctataataaattctctataaaaagtcttgtataataagaaaaatataaataccacaatttaaaaaaactgtcgaaggatttaacacgtagttctcagagaaagaacacaattgaagaaaagcaaatgaaaagatattcaggaaaatgtataataaaagagggattatttcttaaacaacctggcaaaatttacaacagctggtaaaaccaagagtttgtggggttatggagaaacaaggtctcatatacattgctagttggagtataaactagaagaatataccaagtgggtagtatcttgcaaataaatttgacatcttacaaaaatgaaaatgcacaaaccccatgagttctacttcaagaccactacctatgataaacaacatgacatgtaccaggatgttgattgtcatgctatttgtaatagagggaaaagaaacatcattactcttccttagtaggaaatggaataacatacagatattaaaatgaatatgctgagcacagtggcccacgcctgtaatcccagcacttcaggatgccaaggcagaggatcatttgagcccaggagttgaagaccatcatgggcaacatagtgagaccccacctctacaaaaattaaaaattagccaggcatggtggcacattcctgtggtcccagccacttaggaggctgaggtgggatggtcacttgtgccggggaggtcaaggctgcagtgagctgtgatagtgccactgcactcccgcttgggcaacagaatgagaccctgtctcaaaaaaataaaatgaataatagatttacatagatcgacatgaataacactcagaaatataacatcccgtcttcaaaaaaaaaaaaaaacctagtaagctgtactgaattaatctatcctaccatttaaaatttttgttgagggtaaaataatattaaatattccctttatagcaatcctcttagtgctttaagtctgcttgttgggtccttaattgtttcaattttatacaaggtcgtttcctttcctgctttccagcatttcattaagttcttgttcaggtctccagctagatcagtctcattggttctagcaggtgtgggtcttggtgggttggtgcaagtccattcactatttcaactcttcagaaagtcccggaaccagtcagttttgcagttcattcctaatactaagattgtttctgcttcacttatctttttaacttacctcagtgtaccaagaaaaacagtcatcaccatatactatctaggttgaataaactccgcttaaaaattattttagattattttccaaataatttacaaaatacaagaataaagagataaaaaactattaaaaattaaataagaacttaaatatataaataaaatttttatgccatgtttccctggtcttgaggtgttttggattttggtttttggaatatttgcatatacattaagatatcttggcgttgggactctggtctaaacatgaaatccatttatgttttgtatataccttgtacacacagcctgaaggtaatcctgtacaatattttaaataattttgttactgaaacaaagtctgtgtacattgaaccatcagaaagctaaggcatcactatctcagccactagatgtggatggtctgtggttggttggcatcaccattgtttctgagtgtaaatttatatgcctgataaataatcgttttcatacatgtattgagacacaagtacttaacagtaaaaaatatgacacaccattaatacagtgaaaaaatagtgagtttagggtaactaagcagcacaatggcatcaccagaatacctggataagctgttaaacaacagcaacaccaaacagcaacagtttcagtcaccacctacgatgttgtggggggcttttgttttggtttggttttttgagatggggtctcactccatcgcctaggctggcatgcagtggcaccatcatggctcaccgcagcctcaaactcctgggctcaagccgtcctcctacctcagcctcccgagtagctgggactacaggtgtgcaccaccatacctggctaattttaaaaatctttttgtagagacaaggtctccctaggttgcccaggctggtctcaaactcctgggctcaagcgatcctcctgcctgagcctcccaaagtgctgaaatgacaggtgtgagctaccatgcccagctgatgttgtgttttgattaaaagattatcatacagtaaccccctgtgtgtggtgcacctttcagattttggaacattttggattttgaatttttggattagggatactcaacctgtataccccaaatgggcaggagcctctgaatgcagtaactgttcatcagctgtcctgcatgaacttacaaatactgattctaagtttcaaatacatctttgttggcttctaaattattattacttctggttcttcttgcacttacagcatcaaaacataatgctttaagaatttttttgagatctttggctcctaattttgttgaagagaggatgaccattatatgttccacagttgcaaaacatttttatttttagatttgtagatacctttcagaatgatcaattctgttttttatggtcaatccaattttttaatgtctacttcatctatttcttctggctatctctctgtaatacctgccttcagcatctgtctacttttaaactatatcaagaaaatttggtgcacaaatgaaataaaagatgaaagaatactgtcatgtgtccttttagcaaaatgggatggcctcatttcttgtcacaagatattccacaaagaagactttctattgaataagtaactgaatgaaaatgctttgtccttagattaaaagtatattattcactcattgattcttgagtttgagaaaatgtatgtagggcatcatcatctgaagacacatagactgagattttacttataatcatcaatttcagcatctttattagagtcctaagtgctcctatcttattctttgtgttcaacttctgactcatctaataattctaaaacagtttcctcagattttcttcgtcattctggctagagaacttacaaatgttaatgcttaatcgtattcaataaaatgtagaatgaggtcacaaaagatgttagctccagacttcttttatgccttcttgaaagataacacatatcttgcacaacacagtaagaaaactgaagagtgatgtcatagtgatacttgtttcactgtttctaagtaatttagtcattttttattatactttaagttctgggatacatgtgcagaacttgcaggtttgttacataggtatacacatgccatggtgactggctgcacccatcaacccgtcatctacattaggtatttctcctaatgctatccctcccctagcccccccacccactgacaggccccagtgtatgatgttcccctccctgtgaccatgtgttctcattgttcatttcccacttatgagtgagaacatgtggtgtttggttttctggtcctgtgttggtttgctgagaatgatggtttccagcttcatccatgtccctgccaaggacatgaactcatctgtttttatggctgcatggtattccatgtgccacgttttctttatctagtctatcgttgatgggcatttgggttggttccaagtctttgctattgtgaacagtgcctcaataaacatgtgtgcatgtgtctttatagtagaatgattgtaatgggattgctgggtcaaatggtatttctggttctggatccttcaggaatcaccacactgttgaaacagcatggtactggtaccaaaacagatatatagaccaaaggaacagaacagaggcctcagaaataatgccacacatctacaactatctgatctttgacaaacctgacaaaaacaagcaatggggaaaggattccctatttaataaatggtgttgggaaaactggctagccatatgcagaaaattatacaaaaattaactcaagatggtttaaagatttaaatgtaagacctaaaaccgtaaaaatcctaaaaaaaaccgtaggcaatacctttcaggacataggcatgggcaaagacttcattcttctattttcttattttaatcctttttaagcatagttgagaataattgatgagtaatgatgtaatttctagtgtgatgaaatagcataatgtgtcttagattcataaaaagatctagtagatccaaatggcaattgtaagatagaattttattctatttttttaaatattgggttttttgttttgtttgtttgctctttggaaaaaggaaaaaagtcatgagatatcaatttttataaatagtactacttaaaacagaaactcagaaactgagattgggtctaacggaccctaatgagatactgaggattaaacactaggcagaagtgagttaaaatgccatatggagaagcattttataacatctcagttgtgatagttaccacatggctacataggtaactttggtgctgtttttaaagttgcaagcaatttaaatattaaactactgatgataaaattgagttagcaaagaatttccagttcgatattaattatagccagccttttcagttatacctttctcacatccagaaatggcttgatgtactcagctaatgacctcatgcaggatatatatgtgtgttacatgataaagaaaaacatcacttctgtaattttggacagtccacactgacggagatgaacacttgcatataggtcaaactagttaaatacagaacagccgcttttgaaagctgttgccagggctcaacagcgtcagctctgtttctatggagaaagactttgcagatgttaaaaacagagctagaagccaatgaatggaagaggattgtgctgtggaaatttaatttttttgataaagggtttattgatgaatcagctatattagtctgtgaacgttaatcttgacatcttctttacccaattcccaatttcttggaataagatcttgcttttatttaagtaacacacaatgtaaaatttgatgttattgtactgactaggtggggtaagggacctgatgacaggtaacaagattagtaaggttctgaaaaggtcagaattgtactgaattatgtttagaacagattgcctccatgatcatttaatcaaacagtgttcgtattgtctttgtccttgtccacatacgtgatttttgaggttgggctgagaaggaaatcatgattccatcaacaacataaggcacattgacagtaaaactcatatattatagcagctttttgtttcatgctgtatagggcagacaaccttgaagaaaaaaaaaactttaaaaaataatgtaaaatttcacagtttttcagtcacaaacagaagtatccttgttgtcactgaagatgacaagaattaatatcctgctgtatagaagtactttggcaaagttaaggttgtagttccaattcctcatttccaattttttctccagatggaaagatgaacagtttttggtattgaatttttttttaggaagcaagttatttatcattagatatctattcagtaaatgcaatgatacagaaaaatgaagtttttttccctcagatttgaaattaggttttaaaatatggagggagaacaatttgtaagtaatgttcaggaacaaaaataaaacctaatgaaactttagaaactttgatggacatctgtcatcctacatacaattgcattaaagaatagaatttattattattttatctggtttattatgctgtaaaatgaatttttctctttttgtatgtagttttatgaaatttcatacatgtatagattcatggaaccactgtaaaaatcaggatgtagaacatttgcatcacccccaaaaactccttcatgcagtcccttactggtcaccctttctttttagtaaccctggtaactaccaatgtgttctccatccctgtagttttatcttttcaagaatgtcatataaatggcgtcatacactatgtaacctttggggactggctgtcttcagcataatgcctttgagattcatccaagttgttgcatgtgtcaaacatccctttttattgttgaatagtatttaattgtgtgggtgtactatcatttgtttatctcttgacccactgaaggccaattgggttgttttctagtttggggcaattatgagcagagctgctataaaccaagtagtggaatttttaggtcatatagcattttatctattttttatttaaaaatatatattcagggtttgtttttgacccagttgaatttccttcaggtcatttttggaactctttcttcctatgtctgatgtaacatttcatctttcatctttgtcatttttttattcccccttttcttcagattactataggtatattctggtattgtagcccagaatctgtcctgcttttatattcctccagcttaattatatgatccatcttcttacggtatctacggcttgctacaagactattctttactatttgcagaagacgttcagatgtatcttgctatccttttttattcagttgtgtatatcttgttctctatttggaggcctttccaaatagatgtcttgttaactctttaatcttatcatgctagaaacaaacaaacaaaaaaaattcccttgtatcttttcccttctgcagcttccttatcatactacagggtaatttcttttcttcactgtcagtcttccaccctacatgcaagcaataatcaaatctagcatttgctgtttggtcatcaccactcctgtcaccaaaattctcattctgtttagattctgcttgcctcatttatgtaccattatttgtttctcactgaccttccaagtgcatacttcttttcatcctaaagccaagaataaaatcattttatataaagagcattctactttgcagttcatttactgatgtcctctgtttcagtaggaaggcctaattctagatttcagtctgtcatgatagtactataacttctgcttctcacattaggtaaattttattatcccttttataggaccttgactgcctctgggccttctgttcagttgaacccacatgcttctaacttcttagctattagaccctctctttccccttttatatgtctttgttttggtacagcttctcatacccaaaagcaggtatacctgttagtaaggaggatacaagttgtatttgtaggtggtatgattgtctacctaggaaattcaaaagagtcagatttttttaaaaacttagatattataaataagagtaaagtagccatatataaaataaatacataaaaatatatttccttcatacttctatactgtttctgaaatataatagaaaaatcccatcacaattgccaccaaaaaacatagctaggaatctttatgaaggaatgaaggaatttaaacaacaaaaactataaaactttattgggaagctgggcccaatggctcatgcctgtaatcctagcactttgggaagccaaggtgggaggatcacttaagtctaggagttgaagaccagcctgggcaacatagtgagaccttatctctaaaaataaaaataaaaataaattttaaaactttactgagagacgtaaaagtgttgaataattggagaggcattattcttctaaaaaaccaaatatgctatacagattttagtatttcctaaacttagatatttaacctaatttcagtcagagcttgggtttttgtctgttctttatttttttatttttaattggtggaggttattccccctcataagaatgattctgatgttcatttggaaatacacatggttggaaatagccaagatagttatgaaaaagaagaatgtatagaggagaagagcttcttcaatgtactactgtaaagttatggagataaaaacatgaatgaatccattgagcagagtagacaggctggtaataacctagcatacatcaaagtccaaaccttggtatgatggcagctcagtcaacgaagaaaggagggataatttagggaacaatgctgggtcggttatttgaagaagaattagttggcttctcactttacttgtaccatacacaaaaataaaacaccagataaagaattatatgtaaagcaaaaatttaagaaaagaaaatatgtgaccatcagtgtctgtaatggggaacaattttaaggataaaactaatgaaaataccataaaaataaaaattgtgctggctgtttagtagaaacagaaaacgccttccacttaccgaaaatataccataaataggctgggcacagtggctctcgcctgtaatctcagcactttgggaggccgaggtgggcaaatacctgaggtctggagtttgagaccagcctggccaacgtggtgaaaccctgtctctactaaaaatacaaaattagccagacttgatggtgcacgtctgtaatcccagatgtgagaggctgaggcacgagaatcgcttgaacctgggaggcggaggttgcatgagcagagatcataccactgcactccagcctgaacgacagagcgaaagtccatctcaaaaaaatatatatacttatatatatgcacacatgccataaagaaaagacaactggcaaactagaataaagtagttacaagtataataatggccctaatgtataaatcattttttaatcaataggaaaagctcttgaatttcaacagaaaagggtatagaagacatatcaaatactaataaaattaccaatggtaaaaacatgattttttaacagcaccagccccttcagtaattagataaatgtgatttaaaaacaacagaaagatactattgtccatctatcaaattgagaattacttttaaagtgtttctaatattcattacttgtgggaatataccaagataggcactatcaggtactgtgctgggattatagattgataaaacctttctggaaaagtgtttctactttttcaagtgttcctatttcaagggccttaaaatacttaacacaccttttaacctaacaatttgcctttagcaagtattcatctatattgtcaagcgtttaagtataaaaatgttcattgtaggctgggtacagtggctcacatttgtaatcgcagcactttgggaggttgaggcaggaggatcacttgagtcctggagttcaagaccagcctgagcaacatggcaaaaccccatctctacaaaaaaaaataaaatattttccaggcgtggtagcacgcatctgtagtcccagccactcgggaggctgaggtgggggattgcttgagcccaggagtttgaggctgcagtgagctttgatcgcaccactgcactccagcctgggcaacagagtgagatcctgtctctacaaagaatgaaaaaagaaaatgtttattgcagcaacatatataatactaaaaacttagaaataattaaatatctaacagtaaggaatgaatatggagtaggagagttaaactgtgaaaccattcatatgattaaatattatagagctattaaaaatcatatcatcggccaggcgcggtggctcactcctgtaatcccagcactttgggagggcaaggcaggcggatcacaaggtcaggagatcgagaccatcctggctaacacggtgaaacccatctctactaaaaaaaaaatacaaaaaaaaaattagccgggcatggtggtgggcgcctgtagtcccagctactcgggagtctgaggcaggagaatggcgtgaacccgggaggcggagcttgcagtgagccaagatcacgccactgcactccagcctgggcaacagagtgagactccgtctcaaaaaaaaaaaatatatatatatatatattgtatagggatgggaaagggtttaaaataatacctgtactgaaaaacaggatgcaaggtattacatagctccattttggctgagtttgagatgattgtgatttctttattttttgctattttcccacattttttataattatatattttgcaattggaagcaaaaataaccattgaaaatcgttttcaaagaataatattcaagagaatacaaggtgcagtaagttcttaatatttagttaaaatatagaaatctgtggaccattaacagcacttatctttaggtaatgtaatgatgttttatagatgggtctttattgatgggatgtcactatgttgcccaggctggtcttgaactcctggcctgaagcagtcttcccacctctgctttccaagtagctgggattacaggcacaagccatggcaaatgtagtatattttaatttatgtttttagtgatggaatctcactgtgttgcccaggctggactccagctcctgggctcaaggattcctccagcctcagcctccagagtagctgggactataggcacgtaccactctgcccagctttatttttacactttatttgttttacaacttttgctctgttaacaaatctactactcctttaaaaagttaaaaaacattctcttattaaaacaaagattaggctgggcatggtggctcacgcctgtaatcccagcactttgggaggctgcgctgagtgaatcacctgaggtcaggagttcgagaccagcctggcaaacatggtgaaaccccgtctctactaaaaatacaaaaattagccaggagtggtagcacatgcctacaatcccagctactcaggaagctgagacaggagaatcacttgaacccgggaggcagaggttgcagtgagctaagattgcgtcattgcactccagcctgggcagcagagcaagacttcatctcaaacaaacaaacaaaacaacgattatatccttatcagagatttaatggatactaaccatatttaatcctcagtctcattatgctcatttaatttttattatccgtatgttgtcatatttaggttatgttcattttttaccagttttgttaatccctagtgttttttgtttttgagacggagtctcactctgtcgcccaggctggagtgcagtggtgcagtctcggctcactgcaacctctgcctcctgggttcaggtgattttcctgcctcagcctccagagtagctgggattacaggcacctgccaccacacccagctaacttttgtatttttagtagagatagggtttcaccatgttggccaggctggtctcgaactcctgacctaagttgatccatcctcctctgcctcccaaagtgctgggattacaggcaggagccaccgcacccggccgtgttttttgtttataaaagaaaaaatttccagagtgcactttactccctgataggagactaaattacttaaatataaattttagaaggtacgtgttaaattaacctaatgaattagtagcattcagaagtgtttgtatctgttaaagattcaaaatatacaaactaatttcttttaatggtgattctatttctagtaaactaaggcagaaatcattatgcagaagaaacagcaccctgttaaccatgttctttttataaaccgtctctgttctcactttattgttaggaaggcgtaatctgttttcatgtaatataagtacatgtgagtcatgttgagtttcttcactcatttgtccaattcccagtcaacctgtaggtggagttaacctttagttacataatataacgaaacaaacattaaacctactgcttctgggacagtcttctcaccaaaattcagggaaaatgggagggtgttgccactgactgacttaatgaaagtatctgacaaatgtaaggtctttcaaatagtgagataagaaatgtatataaattatttgatcgactacttactttctatctatacacacacactatcagtatataatgtgtattttcattttatagctattaaatatgaggttctagaatgagttttcagtttgcagaattctgagaatctagttccaacacctttgagaggacaacaaccacaattgcacttgccatatttattagtcaaaatgaagcgaagtcaatctgttgaaagctttgttttgtttttctgattagtttgtttaataagacattcaaattatgatctttaatataatttcttcccctaatagcttggtgctaacagtggtttgcacatcatcatctttgatgaaattgatgccatctgcaagcagagagggagcatggctggtagcacgggagttcatgacactgttgtcaaccagttgctgtccaaaattgatggcatggagcagctaaacaacatcctagtcattggtatgtttactttttaaaaaagtactattcattcaaaaacgttagccataagttctgaattaagatgtgtgtaggttgtgattaaactgttttgccagtgtttccaaattagaatccagtgatattgaagaatctattgtaatgcctaggcttaataggaaaaataaaagatggatttcagtcacttgtaggtttaagcttatagctcacccacaggtgaaaaagatgtaggttgaagcttatagctcacccaaaaatgaaaaatacacatgaaacaatggaatgcagtggttttcaaactgggtcttgcaggccttcaggggtcctcagaggtgctttcagggtcagtgagggccagggagtgcgtttcagatcctacatcactattataacttcctcttttagctgttttatgtactgaggtgcttctgaagatgacttctggggaaaaaaaaaaaaaaacaccctgctgttttatgaagtctgaaaaccactggcctgtaaaaaagagaaggaactttggagtcagagagatcgtgtcacattgcccctctgtcactttgacagattatttaccctttgaatcttaaattttctttttaaatactggaagttttcataacatttatattccattggcttatacagtagtgaaatagtaaagcaaagtctccttagcttgttagggaaattactattcttacatatactaaaaggacatttgattttatttttgaactctgatcatttgttgttttgttttaacatctgtgttcaggaatgaccaatagaccagatctgatagatgaggctcttcttagacctggaagactggaagttaaaatggagataggtaaggagatctgtcactgattgggtgtgtggtggggggagtggaggcatttagagttcattaacaggaacaatgtcatatggtgtagtattttttagaaaaggtttatatcatgagaagtagatgtttacatgcttgagtacctataaggaaaacattaggatcataataatctcctctaggctgggcgcagtggctcacacctgtaatcccagcactttgggaggctgaggcaggtggatcacttgaggccagttgttcgagaccagcctggccaacatggtgaaaccccttctctactaaaaatacaaaaaacttagccgagtgtggtggtgtgcacctgtaatcccagctactcggaaggctgagataggagaatcgcctgaatccaggaggcagaggttgcagtgagctgagatcgtaccactgcactccagcctgggaaacagagcgagactctgtctcaaaataataataataataataatgataatctcctctgatggtgctttcgagactaggaaaatgcctattttatttttaatttcatcaggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggtcaggaaaatcagctaaacagattataaacattatgccagtattctttctctttcctttcaagcatatcaaggggtagggaaatgctgacttttggtggagaagagatggtaaaaggaataagaattaattgtcaactgctaaatcttcagagtagcaggaaggaagataatgtttgcatctgccctgtagtaaccactgactcatctaccttaggtcatcaccatctgacacagacacgtaaagtgaaaattttgaagaagtgtttttaaatctttgtattgtattaaaagttgtaatatggccaggcatggtggctcatgcctgtaatcccagcactttgggaggctgaggcgggcggatcacaaggtcaggagatcgagaccatcctggctaacacggtgaaaccccgtctccactaaaaatacaaaaaattagccgggcatggtggcgggcacctgtagtcccggctactcgggaggctgaggcaagagaatggtgtgaacccaggaggcagagcttgaagtgagctgagattgcgccactgcactccagcctgggtgacagagcgagattccgtctccaaaaaaaaaaaaaaaagttgtaatatgtcagaggaagtgggagtttccacgtactagaattttgggggctgctttattcagcaaatatattgaatagttgatgtgttcaagctattgggctggagacataaagataattgtgaactcttccctcaaggagttcagagtcaggaaaatggacatattttcaaattagtacaataatattgtagttaccatggtagaaatacgtactaggatacttttattttgataaagtgctcttgatcttccatctcttctctcctttaggttttagttaccacctgtagacagatttactgaacatatctgtctcctactttcagatttgtactaaataccctcacctagatgttttatcaggtctcagatttaatattgcaaaaccaaatttattgtcttttttactactttcctttctgctcgcatttccctgtttatcccaatttcccaggcttaaaacatcaggattatctttgattcctgacactctactgtgccctaggtcaagtcacttgccaaattttttcagttctgtcttggcagtgccttttagttctcactgccactacccaccttctctttgattaaccttcctgtatcatatcattcaaccattcagacactttcagtgattccccatcatttacaaaacaaagtacaggcttcttttgggtcttttgggtcctctagatctgaccctaactggcctttccaaatgtgctcctgattattctccacatacttcagccaaacttaaataatcaccggtcatcagacattaatttatttttcaacatctctgctttggttttgttttttttgcatcactgaggatcttcatcctctacgtttacctgtcttttcaaaacctggctcatatgctaccactgtcctcacaccttttcacattttccctttcaagaatgttatacccgtttccttcttgaaatagtaatgtatcatttatggtactgtcagttgactttggttcacagtagatttattcggcatctactgcatgctagaccctgtgctaggagttaataccccaactgcaaagaagtaaagtacctaccattaagctgccctcagtctaaccctccacgtgcagtaacagaaagtacatgcaaggcaagagagtgaacgcatgtcagatatggtcaacttgtggggtgagagaaaccttcatatgcatgtctgttggtagagcagggccttttaggtagagggaacaacatatgcaaagaagcagagacacagaatagcatagtgcgttggagtagtttagtattgcttcagcatggaagttaggggagggatggtagagagattgtgggggataagtcaggagactaaagtagggatggagcacaaagagccttttatactctgctaagaagtatggactttttttctgtgagtagtgctaagccattgagttttaagaatagcagtgacatagtgttaaaacataagatcactctggcagctctgtcgagtggagtagttagaggagtggagttggcgacacaggacaagagggggagcttttataacagttcaggcaagaaataaaagcctgaacagttaggttgagtatgtagatatttgggtatatcctatcactggttctagaccaggaatccagccaactaccagtttttataaataaagggcttttttggaacagtacacattaatttgtgtactgtctatggctgcctgcatgctacagtggcagagttgagtatttgcaataggggctgcatggcccacaaagcctattttagtgcttttattttaggtactatctgccactttacagaagtttgctggcccttgttctagactttaaatccttatcttattcacctcagagtctcccatagtaccccaaatagatctaaataatgagcacatggtaggtgtccagtaaattatttttcttttttttttttgaaacagagtcttactctgtcgcccaggctggagtgcagtggcacagtcttcgctcactgcaacctctgcctcctgggttcaagtgattctcctgcctcagcctcccaagtagctgggactacaggcatgtgccaccacgcccagctaattttttgtatctttagtagagatggggtttcaccatgttggccaggctggtctcaaacccctgacctcgtgatccgcccgcctcagcctcccaaaatgttgggattacaggtgtgagccaccatgcccagccaatattttttaaatgagtaaacttacgtaactattctgaatcacgctctatccataagtcataatttccctacataatagaggtggatttgttctagctcaagaatgccaaaggtttggatggtgtgggaatattgtattgggtctttatataatggatccattcagggactatgtttttattcttccttgtttgtttgttttgagacggagtctcactctgtcgcccgggctggagtgcagtggtgcaatctcggctcactgcaagctccaccttccaggttcagccattctcctgcctcagcctcccaagtagctgggactacaggcacccaccatcacgcctggctaagtttttgtatttttagttgagatgggatcaccgtgttagccaggatggtctcgatctcctgacctcgtgatccgcctgcctcggcctcccaaagttttgggattacaggcgtgagccaccatgcccggccatgctatactgttttaataagaagagatggcaacttcaagaaaaatgatgtaaacagtgtgaaaactggtccctaccatactgatctttcatctcagaccacatgggtgcatcttgatgtaatccacagtaactagtttactagttgtcatatttttcatatgtgttggccatggaatttttctcttatttagtcatctgtcattttaactacaataatcctatcccaaaatttcactttaagccgttgtctcagtaagaaacatgctttcttcaagcatatattgggtttatctacatatgaggcaatgagggatggtgggaagatcgcagatatcgtagtcagaaggtgtggttatgcattatatttcttccacctttttgtttctgacctgtcaaggggagacactacctatctaatcagatttttatgagaatgaaagcaaatactttatataaaagtgccttgtaaactctataaatgctagttatctccatttttttaattggctgatttgagaggatatcagtacttttcaatatatgaatttctgatttttattgactctttgtagttacacattttctaattgtaaagctaaaatgtttgtcacccttgtacataatatattatccttctgatttgcaagtaagcagtagtgcaaatagttcatgtttccatcacttttttccacatgatagaattatctgtaagcttcaggtgatatgtattgacttgcgatcattgctccttgtaccaaacagctcctaacttttcaccatatcaatggaataactatgtaggcactttagggatgagaaagctatgtaagacactaaccttacccccaaaaagaaatattactaacatttcatcttctgcattttaaaaaatctgcattgtcagaaggtctttaaagactatttttccaatgactcgtccttggctaaacaaaagaagtacagttttagtcttccattgctatagatgtttgtagctttaatagtgattgatgaataaatatttaaattgaaacttataaagttgttactgaactttaaaacattcaaaacgtacaagtgttatgatgttctttctttgtattttaaaaatccattattggtgttattttgcttccttttcaaaagattgaggcctaaagaaagatttagtcaggtggactaaacaggtctttcctgttaaactgttttttcaggttttctgagacaagtggaaaatctggtcagaaacacctgttgttcatgtcatttatacttgaacctatgattgcggtcaactaaaattcatgtgacatttggttgtttttatcttgaaaggaatttctgcttcaggttgagaagattcataacccaaattttttctctaatctgttgtgaggaaataaactgaggacacacacacacacacacacacacactttctctcacatacactttccacctgagtcaaagctctaagttatgtttacagaatttcataaaattatttcttatttttttgcagaatttttgattgattaaggtcattctacccttaatttaagaggaatgataagaactttgaaaggtcagatttaaaaggttatgaaatttaagggtgaccacttgatatttgctagtgttgaaatacaagtttattagtttctgcaggtataagctgaaagatgctgcctcttctatattgattagctgttataaataaaatgcaggaaaaatgttgctaattcaaacaaatgagaaaaggttttctgaaaaagtaaaaattcagaattatagactttttaaaattttacaaattttgataaaatgctaaaagtcagctaagagcagtccttagaaaatttattttaatgagcaggtaggaataattgacaattggaatattgatggcttacaattatgtaacttacagaattccttatgtgcctgaaaacagtttgttttgaaatacttcttccccacacccatcttaattcacttttaagaaaggactcagcaattaattgggtgagtcttttcttaataattagcaaaatgacaagttttataccagcttcagtcctaaaatctatcgtattttttggcaaattttgaaagatgggcaagatttttctttcatactgctgtatgtatctatcatttgaattcggttttactgtaagagaatcagaatgcaaaatattatggtaaaaacctaggcctgtgtaggaaagaggtgtttaaagtgaggctggtagctttgttgagattttaatgtttcggtcagagctcttgtcttccctttggcctgagagtttgtatcttgtagaatcctttcagatgtatcaaaaagtttgaatcagagttaaaacttttatataagggtatctaggaaggaagtcctgtatctgccttttataacttatggaaacccccaggtttgtataagtataaaatgagataatgtgatatggtgaaatgagatagtgtgtatgaacatactttataaactataaagaactgtagacatttgtatattattaattatcataattctttcacggatatgcttgtttcctgtgacaccatttttctttttttcttttttttttttttggagatggagttttcttcttgttgcctaggctagagtgcaatggcgtgatctcggctcaccacaacctccgcctctcgagttcaagcgattcccctgcctcagcctccagagtagctgggattacaggtgtccaccaccatgcctggctaattttgtatttttagtagagacagggtttcgccatgtaggtcaggctggtctcgaactcccgacctcaggtgatccgcctgcctcggcctcccaaagtgctgggattataggtgtgagccaccgtgccaggcccatttttctttttttaaacttagaaatgccaaataaatgcgattaatatttatcaaacctcatatgtgccaatataagccctattaataatttaaatgtttatgtttttttgtttgtttgtttttgtttttgagacggagtctcactctgtcgcccaggctggagtgcagtggcgccatcacaactcactgcaagctctgcctcccgggttcacgccattctcctgcctcagcctcctgagtacctggggctacaggtgtctgccaccacgcctggctacttttttgtatttttagtaaagacagggtttcactgtgttagccagtatggtctcgatctcctgacctggtgatcctattgcctcagcctcccaaagtgctgggattacaggcgtgagccaccatgcccagcccaataatttaaatgttaattgttctattgaagtaaaatatttgtctctttgttactttttactttatttttaaaagtatagaagttatagatgatggctttctttttgtaaaagattcaagaatgtcaaagcatatagggaaaaatgagaaaggccatctctaacaccactttcctttccctctccagagttagccaaaatttgggatatatctttgaagtttgttttctttatataatatttacattcatatacgtatgtgcttttttaaaaaaatgaacattaatggaattatactgcagtttacatttttcacttgcaaatattccttggatagctttctgtgtcagtgtatgtaagtccccttcattattttggacaaatgcagagtattctagaatattgccacataatggaaaatataagatccatgaacacagggaccttttctgttttatttactgctatgactccagttcctcagatagtgcttggtgtctggtaggtattcagtaaatagaattaatgaataatttatttaacatatggattatttctggttgtggctgttgaaaaaatactgttgtgaaaatgcttacttgcctccctgtgcacacaaggaatcattttctagggtagccatccaaatgtcttttcaaagacatggtttcattgtcttctagtttctagtgttgccagtgagagttatcataccaatctcgttctggtttctttgcaggaaacctgttttgtccctcagaaaggttctaggactttctcttcacctttggtgctctgaaagtttacagcagtgggtctggacagatgtgtgcttcttttcatttatcccgatcatcactcactgaaccctttaaactgcagaggcacacctttcttcagctataggaaatttttttctcttctgtcttttattgtttcttctctatgactctttctgttctctccttctgagactcctgttagatcacagttaaaacttatggatatttctttcatgctttgtagcctttctgtctcactttctgtcattttgtgggatttggggcggaagggaagataaataactgtgttctgtttgccatcttcacccagcttcctgccatagttctttttatcccacaaggatgacttttttttatatctgtcacttcatttgtctcacagtctcttcctaaaaaaaatatgactcatatttcataataattgatggaaggttgatatttatttaacatgcgtttgttttatagtcagctttttttgaaaatgctttttttttcaaagccatgataccaatttaaaaattaggctgtgttgttttgtgctattggtagtgagcccagtcgctttaaaacacgtgttggtatcttaatcactcatctggtccaggcagctccaagtgctgataaaggccttgatgcttctccagatgtctaaatgctagctccaggtgcagtaagcagactatttggagctggcacatagattctgaagcacaatgtattaatacaaatgaaagttttaggttcttggtctcctagagtaatggttcttaagcctggttcagtaccagaatcacctgtggtacttggtaaaactataaagaccctctaataggcctgttaaatcaaaatcctgtggggaatgggactgagcgcctgtatatctctgaaggctctggaggttattctgatatgcagccaagtatggctgtgttttcatttctgtatatattttctttttgtatggatttttcactgttcttactctctgtatgtattttttcttactcatgcctcatgagttaaaatggctatacagtgtcccttggtacagatgtgttctaatttacataactgatcccctcttggtagacattattaatatgcttcccatcttttttcataacaagttactttagtagatatacttgtacatataactttgtacacatttgtgaatatatttaggggataaattactagaagtggacttgttcagaggatatatatatttgtgaatttgagagatgtgttttctttgattccaatttttaaaattgttttaaaatgcccataaaattgtccgggcgtggtggctcacgcctgtaatcccagcactttgagaggccgaggcgggtggtcacaaggtcaggagatcaagaccatcctagctaatatggtgaaaccctgtctctagtaaaaatacaaaaaattagccgggcgtggtggtgggcacctgtagtcccagctactcgggaggctgaggcaggagaatggcgtgaacctgggaggtggagcttgcagcgtccgagatcgcgccactgcactccagcctgggggacagagtgagactccgtctcaaaaaaaaaaaaacaaaaaacagaaaaccataaaatttaccgtgtaaccattttaaatgtacaattcagtggcattaaatacattcttaatgttgtgcaaccatcactaccattcatctccagacctcttttcatcttgtaaaactaaaactccatacccataaacagtaactccccattccttcctctccctatcccctggcagccaccattttactttctgtctcttggatatcagctactccaggaacctcatataagtggattgtacagtatttgcttatttaacttagcgtatggtcctcaaggttcgtcatgttgcaggatatcagaattttctttctttttaatgctgaataatattccattgtatgtacgtaacacattttgtttatccattcctctgtcaatggtcatatggatttcttccacattttagctattgtgggtaatgctgtcatgaacaaggctgtacagatatctcttcaagaccctgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaattgaatatattcttaactattcttaaatcttggaagtccttacattttgtttttatctcttcttaggccagtactaaagtggaagtggacatggagaaagcagaaagcctgcaagtgatgagaggagacttccttgcttctttggagaatgatatcaaaccagtgagtatgcccattgagtgatatataggccaaaaagtaatgataataataactcaggcgaaacgtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcattcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcgtgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattgcacactccttatgagaatctaatgcctgatgatctgtcactgtctcccatcacccccagatgggaccatatagttgcaggaaaacaagctcagggctcccactgatgctacattatggtgagttgtataattagttcattatatattacaatgtaataataatagaaataaagtgcacaataaatgtaatgtgcttgggctgggcatggtggctcgtgtctgtaatcctagcactttgggaggctgaggcgggcggatcacgaggtcaggagttcgagaccagcctgaccaacatggtgaaaccccatctctactaaaaatacaaaaattagctggatgtagtggtacgtgcctgtaatcccagctactcacgaggctgaggcaggagaatcgcttgaacccaggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagttttttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctcccgggttcaagcaattatcctgcctcagcctcccgagtagctgggattacaggtgcttgccaccatgcttggccgatttttgtatttttagtagagacggggtttcaccatgttggctaggctggtctcgaactcctgacctcaggtgatctgcctgcctcggctttccaaagtactgggatctcagcatctgtttgtttttaaaccttccctagtctgtgcttatgtgttttgcttgtttgttttttgtttgtttgtttgtttgtttgttttttgagatggagtctccctctgtcacccaggcgggaatacagtggtgtgatctcggctcactgcaacttccacctccctggttcaagcagttctcctgcctcagcctttcaggtagctgggattacagtcacatgccaccatacccggcttatttttttgtatttttagtagagacagggtttcaccatgttggccagactggtctcaaactcctgacctcaggcaatccgcccgcctgggcctcccaaagtgctgggattacaggcgtgagccactgcgcctggcctgtgtggtttttaaattaactttttctagtctactaaggtttactcagacctttagcagttgttcttggatactgactaggcccaaagtcctcttctcatcaatgtattggcaaatacactcacttgcgatgtgatatgagaccctgaggtttacctcccaaacagcaggatgtctgttttgagagtttcctggccaagtggtggaaagtaccatggaaatggagtcttccttgcttcttacttaacttgagtttggaccatagagaagtcattcttgtgtggacctcagtttactcacctgtacagtataggatggactagatgatctaatgatcaggggattggcaaacttgttcttagggcaccaattagtaaatattttaggttttgcaggccacctggctatgtcacagctgctcagctcggccctggtaggatgaaagcagccatagacaataagtaaacaaatgagtgtggctgtgttccaataaaactttatttacaaaaacaggctgtggccggccatagtttgttcaccccatttttgagctcttgacattctttagtctgtgatttcgataattagtttaggaaaaaagctttgactttcataaataatgcttctggaaatctagtaaaacctttaaattttggccaggcatggtggctcacacctgtaatcccagcactttgggaggccgaggcgggtggattgcctgagctcgagagttggagaccagcctggccaacatggcgaaacctcgtctctactaaaaatacaaaaaattagccgggcgtggtggtaggcgcctgtagtcccagctacttgggaggctgaggcaggagaatcgcttaaactcaggaggcggaggttgcagtgagccgatatcatgccactgcacttcagcctgggtgacagagtgagacttcatctcaaaaaaaaaaaaaaaacctttacattttatttttgctttttccctttatcaggaaagtaatgtagaaaatttagaaaacccagaacattaatattttggttcctctcattaggtaaccatctttgggtggacatgtgtacatacatacatacttttttttttttcttttgagcaaaaaagtacatactttttctttttttctcttctgtcacccaggctggagtgcagtggcgcgatctcggctcactgcaacctccacctcccgggttcaagcgattctcctgcctcagcctcctgagtagctgggactacaggtgctcgctgccacacccagctaattttttgtattttttagtagagatggagtttcaccgtgttgcccaggctggtgtcgaactcctgagctcaggcgatccgcccgcctcagcttcccaaagtgttgggattataggcgtgagccactgcacctggcacatgtatatgtatgtattttttacaaaattggatgaagtataatttatttgctaaatattttcacttatgccatgatatcttatttaatctttaatttgtctatgaaaatacctgctctgctaggggacttctagttgaaaactcattaatttaaaaaattaattttgaattcagccacctattcttttttctaattgtttcttgtagcttttgctttgattggagtaactttattctaggaataaagttgtgtcatctgcaaacatgaatcatgtacacatctgattttcttatatttatgtctcctttttctcttcaaattacattgcctttaccattgatgggaacctgggtaataaagaaaaaagaaaaaaattgcattccctaccacctcctccaaaacaatgtcaaatgttagttataatgataggcatcttagtatgctatcccaatttaatggaactgttgcagatatttaatggttaactgttggtttgagacctttaatgtgttgagtatattcacctatttcaattttttttctgtttaagtttttttttttaaaatcagatatggctattatattttgttaaatgacatcttagcatcttttaagatgatcatatagttttcctcctgcatgctacatattaattacagtagtgtatattcatagaattatattagtagatcttatattgattcacccttacattcttgcagtgaacctctcttgatcatattattttttcatgtactgtttgactttatttatttagttttgagacagagtttcgctcttgttgcccagggtggagtgcagtggcgcgatctcagctcaccacaacctccgcttcccaggttcaagcgattctcctgtctcagcctcctgagtggctgggattacaggcgcccgccactacgcctggctaatttttggtattttcagtagagacagggtttcaccatgttggccaggctggtcttgaactcctgacctcaggtaatccgccggcctcggcctcccatggtgccgggattacaggtgtgagccatcgcgcccggcccgtttgacttttaaataggtattttaattttttagtttatacgtgtacagtgcataatgtatttaagattcatctgtgttgttgtatcagtagtttctttattgctgagtagcagtcctttatatgagtgtatcacagtgcatttatctgttcaatagttgaatatttcaattatttctagtttgtggcagctatgaataaagctgccgtaaacatttccataatgttttttgtctgaacacaattcttgtttctcttgagtaaatacctaggagtatgatttctgggttgtatgtttataagaaactgccaaaactgttttccaaagtagctgtaccattttgcattcttacctgcaaatgtatgaagagttccggttgctctgtatcctccctagcacttgatattttcagggttttgttttgttttttttttttttttttttttgagatggagtctggctctgtcacccaggctggagtgcagtggcgcgatctcggctcactgcaagctccgcctcccgggttcatgccattctcctgcctcagcctcccgtgtagctgggactacaggcgtctaccaccacgcccggctaatttttttgtatatttagtagagacggggtttcaccatgttagcgaggatggtctcgatatcctgacctcgtgatccgcccgcctcggcctcccaaagtgctgggattacagacgtgagccactgcgcctggcctcaagttttttttttttttttttggccaccttaataagtatatggtggtagcttcttctggttttaatttccttgtccctaatgactaatggttctgagcctctttttatgtgcatcttttgatttgccatctgtatatcattgtttatggaaaaatactaaaatcttttttttttttttttgagacagagtcttgctctgttgcccaggctggagagcagtggcacagtcaccactcactgcagccgccaccttctgggttcaagccatcctcccacctctcggcctcccaagtaactgggattgcaagtgcgcaccaccacacctggctagttttttttttttttttaatagagatggggttttgatatgttgcccagactgatttcgaatcctgggctcaagcgatctgcctgcctcggcctcccaaagtgctgagattacaggcatgagccaccatgcctggccaagataccaaaatctttatttaagatgtttaattgggttgctttctttattgttattcttcttttattttattttatttatttatttatttatttgagacggagtctcgctgtgtcgccaggctggagtgcagtggcgcgatcttgactcactgcaagctccccctcccgggttcacaccattctcctgcctcagcctcccaagtagctgggactacaggcacccgcccccacgcccagctaattttttgtatttttagtagagacggggtttcaccatgttagccaggatggtcttgatctcctgaccttgtgatcctcctgcctcggcctcccaaagtgctgggattacaggcgtgagccaccacaccaggcctcttttatttttttagacagagtctcgttctttcacccacgctggagtgcagtggcatgatcttggctcactgcagcctgtcattcccctcgactccaggttcaaggtgatcctcccaccacctcagcctccgaagtagttaggaccacagatgcatgccaccatgtgtggctaatttttgtatttttaatagagatggggtttcgctatgttgcccaggctggtcttgaactcctgagctcaagcaatctgcctaccttggcctcccaaagtgctgggattacaggcatgagccaccatgcctggccaatttcttactgttgggtagtaagagttctttatatattttggatataagtgctttgttaggctgtgtgatgttcatacattttccccatctgtgccttgtgtttcattgtcttagcggtgtctttttcccagagcataagttttaaattttgatgaagtctgattaaccacattttttcttttacacatttggtgttcatctaacagctctacctaacccagaccttgccagactttttctgtaaaaggtcagatagtaaatatttcagccttgctgtccctgttgcagctctgccattgtagcaatgaaagcagtcatagacaatatgtaaatgaatgataatggctgttccaataaaactttatgaacactgcagtttgaatttcacataatttacaaattatcaattatattgtttcgattattagaaaaacaggtagtggattggccatggtttgctgattcctggcctgacaaacccaagttcacaaagattttcctctttgattttgttgtggtcgttgttccacaccttcttttttcactgtttccttaaggtagagtgtacatatttataagggtacatgtaatattttgatagattgatacagtgtgtaatgatcaaatcaggttaattagggtatccatcatctcagatgtttatccttttttttgtattgggaagataacaaatgttctagctattttaaaatatacactaagttattgttgactctagtcaccctactgtgcaaataaaaactgaaacgtattccttctatcttgctgagtttttatgcccatgaatcaacttgtcttcatccctacctgcttcccagcccccggtaaccatcattctactgcctatctccatgaaatcaacttcttaatctctcatatatgaatgagaatatgtgatacttgtctttctgcccttggcctatttcacttaacataatgtcctccagttctatccatgttgctgcaaacagattttattttccaaaccttaagctttatagatgacttcactttttaaatggctgaataatatcctcttgtgcatgtatacctcattttctttgatttttctttctttctttttaaatagagatgagttctcactatactgcccaggctggtcttgaatttttttgctcaagcaatcctcctgccttggcctcccaaagtgctgggattccaggctaaaccactgtgctcctttatgcgtttttttgtttttgtttttgtttttagagacaaaatcttgctctgttgcccaggctggagtgcagtggtgcgatcttggctcactgaagcctccacctcccaggttgaaattattctcgtgcctcagcctcccaagtagctgggattacaggcacccaccaccacgcccagctaatttttgtatttttagtagagatgaggtttcaccatgttggccaggctggtctcgaactcctgacctcaggtgattcgtctgccttggcctcccaaagtgatgggactacaggcatgagccactgcgcccagcccctttgtgcacttttaaaaacatatcttagaatttgtgatacatgttttattttcattttcatttggttcacaatattgtaaaatttctactatgacttactctttgacccatgatttgttttaaaacgtattgtttaattttcaaacatttagggatttcccagacatctttgttgttggtttctaatttaattccattatggttagggaacatactcgttatgatgaattaaaaaaaaatgtagaggtttgtatatggcctgaaacattgtttgtttaggtcaatgttcagtttgtaataggaaagatgtgttctgctgccgttaggtaaagtgtttcataaataataattaggtcaagttggttgatcgtgttaaggtcttccctatccttgctgatttcctgtctgcttgttctagtgattactgagaaaggagtgttgaagtctgcaatgattgttatgggtttgttctctttctccttaaaattctgtctgtttatgcttcctgtattttgaggcactgttattagatgcagaaacatttacagttttgtcctcttgattatttgacccctttatcattctgaaataacctttatttctggtaataatcattatattaaaaaccattatttggccagacatggtggctcatgcctgtaatcccagcactttgggaggccgaggcgggtggatcacctgaggtcaggagttcgagtccagactggacaacatggcgaaaccccatctctactaaaaagagaaaaatagcctagtgtggtggcacacgtctgtagtcccagctactcagaaggttaagtcaagataatcacttgaatccgggagttggatattgcagtgagccgagatcacgccactgcaccccagcctgggaagcagagcaagactccatctcaaaagaaaaaaaaaaaaacaaaacaaaacaggcctggtgcagtggctcatgcctgtaaacccagcactttggaaggccgaggcaggtgaatcacctgaggtcgggagttcgagaccagcctggctaagatggtgaaaccccgtctctactaaaaatacaaaaattagccaggcacggtggcagctgcctgtaatcccaagtacttgggaggctgaggccagagaattgcttgaagctgggaggcagaggctgcagtaagccaagatcatgccattgcactctagcctgggtaacagagcaagactccatctcggggaaaaaaaaaaaaattacttaatattaatataaaattagtgttttatattagtagtataatactgtttttgactagtgttaaaatgacatatctttctctacccttttgcttttaatctagatatcatgatattcatttattttttaatttgtaaaaatagagatggggttttgccatgttgcccaggctggtcttgaattcctgggctcaagccacctgcccacctcaacctcccaaaacgctgggattataggcgtgagccaccatacttggccatatcattatattttcaaatggtttcttgttttttcgtttttcttttaaatgtaatctgacagcgtcttttaattaatgtgttttggaccatttacatttaatatgattgatgatgattggatttaggtttcctttttattatttgttttctggttatttcttttttggggggtttcttctgtttcttttttctgcctatttttggattaactgaatattttttagtgttatgttttattaattggcttttggttatatctgtgctgtgtttttgctgtaggaattacaaaatatatacctaacctacctacttagagttagcattttacctctaaataaaatgtaaaagtattgcaaacatataggtttctttattctagcccccccttataattgtatatatgtgtgtgtgtatgtgtgtatatatctatatacactttcaatgtatgtagatatgtatctatactttcagtgtatattatatctacatgcatacattgtgtatgtatgtagatgtatatctacatacattgaaagatatatatctacatacatatacaatgcatgtatgatacctttggctactacatccttcttaaatttcctgttgccacttatgacctgatttccttgaccagttattcctccttcaaacatccctcttacatgtgatagtcctcagcatttagtttccccaactttcccctaattatcagttgactcaattaccaccaaaatatcaatgacttttttgagacagagtctcactctgtcaccaggctggagtgcagtggcacgatcttggctcagtgcaacctctgcctcctgagtccaagtgattctcctccctcagcctcccgagtagctgggaatacaggtgtgtgccaacacacccagctaatttttgtatttttagtagagacggggtttcaccatgttggccaggatggtttcaatctcttgaccttgtgatcagcctgcctcaacctcccaaagtgctgggattacaggcatgagccaccgcgcccggccaaaatatcaatgacttctagatccattttcctacctagacctcttttctaaactccagatatatatttccaactgcctgtgctgtccgccataaactccacattgtaggaaatagaaaggagttataaaagtttaggttcaaagcaaaatttaaaaactcataaatgagacaaaattttgtgatgataaaggctatggtccacaatgaagatatgaaagtaatgaacctttctataaaatgtataggtgatagagctggtccccaactttaagcctttcagcgattcaagtaactacagaacatcgttaaagtactgagagaaatgtcaatccagaattctatatccagcaaaaatacccttcaacaattaaggcaaaaagaaaaagaagaaagacattttggatgaagaaaatctaagagaatgtgttggcggaagttctgctctaaaataaaagtaaaagaaggtctttaggccaaaggaaaattataccagtggtaatactagaacttcagagataaagagcagcagaaatggtatctgggaaaatttaaaaatgcaaacggttgtttctcctcttaagctctttaaaatatgtatagtggttgaaagcaaaagttaaaacactgctgagactttcaatgtatgtagatatacgtatatatatctacatatatatacatatatatgtatatacatgtagaggtaataatggtagctattttatggagctgatctgaggataaaatgaaagaatgcattttaaagtgcttagcacaatgtctggcaaatagaaagcactctataggccaggcatggtggctcacgcctgtaatcccagcactttgggaggcctaggcaggtggatcacttgaggtcaggtatttgagaccagcctggccaacatggtgagaccccgtctctactaaaaatataaaaattagccgggtgtggtggtgggctcctgtaatcccagctacttgaagtgaggcaggcgagtggcttgaacctgggaggtggaggttgcagggagccaagattgcaccactgcactccagcctggtcgacagagcaagactccagctcaaaaaaaaaaaaaaaaaaaaaaaaggtggggggacaatgttactcttcttccttctagaaacatacattttatagaagttgttttttgaagtctagaagtctgaaaacgcaggagtcaactctgaaaaatctacagtggtttctggggttcaatcttggcatgactttacccctgcatctctgccctcagcaggtagttttgtttatgggtgtcattggttgaacagataattgttttagttgctacaataaataaaacatgatctgtgctctaaaggagtcaacagatgagccaggggggcatgagtaattgcctgtaatataattgtgctcacgctgtcatggaggaccgtacaaagtgtcagaagcacagtgccaggaggcacagcaaagggtagtagaggtgacatttgagcccagccttgaaaactgtctaggatttctcagcatttcagcaaagtaaggcaatttctgtctaaaatatataggcaaagtttttataaaaatacgagaaattaattaaataacagattatgaccacaatgcagatttaaaaactaaggtatgatgagtgccgttgaccggttcatccagacagttcagagaacagaacatccatgtagatccttcttgtattacagaatacaaaggagcggaaaattttgcctcagtaactgccaggtcattctaattaaagtacctatacattgtaatataattcctccattaaggtaacagccaatcaggtggtacagagtctgtgccattcagtcaagaaattcactcccttaacctagactgtgctggaagttcattgacaaattttgttctttggttctccatttttcttcagaattcatgcagaccacttgacttccttagcattttcttttgtgggcgtatattaatgtctttggttaagcttcagcttccgtttgcatcaatcctgttgtaatcgtgcctcctgaggcatctttttgcttcccttgcatcagtttccaaaatcctactttctgcttggtaaggggagtatccattttctttaaagcagtggttttcaaacttgcctgcacatcagaattatttggggagaaggataaaaatacagattactgagcttcacctgggattctgtagatttgagttgcatttgggattactttaaacaatttaccagatgatttttgtggcacctccacttcagttttaggaaggactgtttcgaggcagcttttcaaactttaatgaccatagaaatcacctgaagattgtgagaaactgcagatcctgatttagtaggcctgggtttaggcctgaggttctgaatttctctgaaatgtgataatagcaaatcccttgttgagtagcaaggttgttttttgtttttttcttttttttccaatatcttcatgacattcaatgagtagcaaagtttgaagataacttctggaatttcatctaatgtgtattaatttttactcatctggatcttaggggaaataacctatcagattatagggaagtgtttctcaaagtatggttccccaaacagcacaacctgggaattgttagaaatgcaagttctgggccgggcactgtggctcatgcctgtaatcccagcactttgggaggctgaagcgggtggatcacctgaggtgaggagtttgagaccagcctggctaacatggtgagaccccgtctctactaaaaatacaaaaaaaattagctgggcatggtggtggtactttttaaaatttttttagagacagaatatccctgtgttgcccaggctggtctgtaaatcctgacctcaagcaatcctcctgcctcagcctcttaagtagctaggtacaagccaccatgcccagctatattgacttgtttttgagacggagtctctgttgcctaggctggagggcagtggtgcgatcttggctcactgcgacctccgcctcccgggttcacgcgattctcctgcctcagcctcctgagtagctgggaccacaggcatgcaccaccatgcctggctaatttttgtattttagtagagatagagtttcaccatgttggccagactggtcttgaactcctgacctcaaatgatccacccgccttcgcctcccaaagtgctgagactacaggtgtgggccaccacgcctgaccatatatttacctttatgtgaatttaaaatgtgtgggcgtgaccaagtcgtctgccggctgttatataaaggagactttatcatcaacatgctcatcatcagtcacaaactgcctatttggaactcccttcagttctcagaggatggaaacattctttaagcggccttgtagaaatcctattccatgttaacatgccaaccaattttactttcccagagccacagaatgatatctcattgtatgcctcaattcaatcacctttccattttcaaggaccgatttcaattcctgattggctacttgatctgactgcttcctgctaatcttgttgcctattgtctatattccatttctcattgaattaaccttgatcaaatctgagaactctgcttagtaatgactccaggtatactatacccacttttgtagcttattcaacaccctcttcaatcctggttccacttcctgtgactgaaatgattacctgtgaaatattatttaacttttggacgatgatgtgtttctaacctgtgaccatttcacatagccactcaaatatggtaaaggtatggtaaagatgatgaaacagttacttggcatcattttgtaagtaatgagtttttagtgcgctttggaccttgagaccacttcataagctttagattttgagaatttcacagcataaagctcatcgctgatgcagtaatgaaggaaatgttctacaagttaatagatgagtgagaggagagggcattcatattagatttatttacttactgaactcagagccttgggttactacttgacccccactgttatctagtttaagggtccttttattttttgttttttcgaggtggagtttcactcttgttccccaggctagagtgcaatggcccggtctctgctcactgcaatctctgcctcccagattctcctgtctcagcctcccaagtagctgggattataggtacccaccaccacgccctgctagtttttgtatttttagtagagacagggtttcaccatattggtcaggctggtctcgaactcctgacctcaggcagtctgcccacctcagcctcccaaagtgctgggattacaggcatgagccactgctcctggccttaagtgttcttttctactttagcacatacacctagttgctgtcttttttgctttttataaatacagaaaagagaataatgttttaaaatcaaggaaaggcctaaggcacctgtgagggttttttgtttttgtttttgtttcagtgaaatgaagggaaatggtcaccagcaagaactgtggcaatgttatccaaggtgacaactgtctgtaccacccaggggctcagagcccttctgaagtttcctagatgttccgaaagtctccactgtgactcatgttacaggctggtctccgtggtagcactcaacgtttaaaaattagtcttcattgccaggcgtggtggctcacgcctgtaatcccagcactttgggaggctgaggtgggtggatcccgatgtcaggagatggagatcatcctggctaacacggtgaaaccccatctctactaaaaatacagaaaattagccggcagtggtggggggcgcctgtagtcccagctactctggaggctgaggcaggagaatggcgtgaacccgggaggcggagcttgcagtgagccgagatcatgccactgcactccagcctgggcgacagagggagactccgtctcaaaaaaaaaaaaaaatagtcttcatttctccttcccaacaagcgtttctctttctcttcagtgggaaaaagtaatttcattttttacttgctcattgttttattcattcactcaatcaacagaccatctatcctgtattgtatgccaagaactgtgctttgttctgggaatgaaaaaagaataagatatgttttcctctggcacttatggagcttataaaccagtgacagaggaaggtgcataaacaaatcaacaaagaattaactttactattcttattaatttctaatacaataaatttgactatttgtatcatttgagtttcatgaatataatcatattctacacttacaaaatgaaatagacataagaaagaactggtgatgtaagaaattcacagaaatgtgtaaaatatttcaagaattaacactcagtagatatttgcattgtcaaagaagcttatacatgcagatgaacctctagttgttttagttgcttgtaaaatgtatagaggtatgtgtatttcctctttaagcaggggtaacttggggtgggggatgggtgggttcatcttatctattcttcaggtcatgttctcaagaaggagctactgaatgggaagactgaaacaatttcttttctttgcacagttggtattgataaatctcaggtgtatccaaaataaaatctctggcaggctgtgatatttgtgggtctgtctcttgtgactttaggttcctcttggcagcagacataaggcagttgcacatcaggcccttgcctgaaacagctcctgatgccaagaactggtgaattactactttggtttcaatggatggtcagaaaggatcatcaggataaactttgtggattttctctcactaaccacgctctcctttcaacattgaaattctagactttagacagaagtattgaactgggttacagggaggggatgtgagaggccccctgccattgaggataagtggacatgtctgaattggcctgctacctaaaattaataatctcaatcacttggatggtggtgtccataattttctccactgtttgtgtggcatataataagtaatggttgcacctagcaattcatttacaaatcttacttgattttgaagccatagaacacctcaactgttagcttgaatgactggagtttagtttttatttctcagaacaaaacagtttgaagcctaattaacatcctcggaaggaacttaacactaaaactcctaacagcttcagttttctgaccttgaagaaagggaaaatgaagagaccatggtgccacttccgaagcaaagcctgaagttctgtgctttagaggtggtgttgccatcctatgattgcaggagtctggccttggcttggtggaggagcctgtggataaggcgaaggaaggtctgttttcattgggggtagaggagggtaaggagttgaaatgggaaggatctcttttttcttgctgtctaaaacttgtcttttcagacacatatcaagcctttccctctctgagctactgaagtcctgggcagaggttttctgtcttacaatacagacttttaccttaggcaatacctgacagagcctttaaataagtaaataaattgctttaataaattgatttaatacattgatttattaattaataaattgatttaatacattgatttattaattaataaatttatttaataaattgatttattaattaactaattttgagagagagtcttgctctgtcaccaggctggagtgcagtggcgtgatctcggctcactgcaacctccgcctcccgggttcaaggcattctcctgcctcagcctcctgagtagctgggattacaggcgcccaccaccacacccagctaatttttgtatttttagtagagatggggtttcaccatgttggccaggatggtctcgatctcctgacctcgtgatctgcctgccttggcctcccaaagtgctgggattacaagtgtgagccaccccacccggccagaacctttaaatttaaaattgtacagtgtacttcctgccaagaagcgtaggaggaagaaggaagtaatgtttttccagttttcggttaagaacttgctttgtattaaaatagtccttcaagtctacagccataccaccctgaacgcacccaatctcgtctaaaatagtccttcaaatatgtatctcttatagccttcagttatcccaacaaaattatctaaagatttgtttatctatttattattattttttagagacagggtcttgctctgttgcccaggctagagtgcagtagcatgctcatagctcattgcaacctcaaactgctgggctcaagggatcctcccaccttagcctcctgactagccaggactacaggcgtgtgccaccacatgtggctaattattttttctggagatggggtcttgctgtgttgtcctgcctggtctcaaactcctggcctcaagtgatcctcttcccccaggatcccaaggtgctggagttataggcatgagccacccaccatgccaagtcatcatgtaaagatttacagaaagttttgtgtaaacattgtcttttttttttttttgaagcagagtcttgccctgtcgcgcaggctggagtgcagtggtgtgatctcggctcactgcaacctccacctcccaggttcaagtgattctcctgcctgacactcctgggtagctgggattacaggcatgcaccaccatgcctggctaatctttgtatttttagtagagatggggtttcattgtgttggtcaggccggtctcaaactcctgacctcgtgatccatctgccttggcctctgaaagtgctaggattacaggcatgagcaaccgcgcccggcccattcagccttttttttactcgtagaagggcttcagtggaacaagagtctactagagatactagaaagggtactcaattgataactgacgttgagatttttttctagtattcatggccctcaggcttagggtttgaagtcagaggcagggctgtaggctaatggaggggagtaggctttcatggatgatgcccagggaggagccagattatctgtaccaaaccttttttgtttttttgagacagagtcttgctctgtcgcccaggctggagtgcaccggtgtgatctcggctcactgcaacctccacctcccaggttcaagcagttcacctccctcctgcccaccaccacactcagccaatttttaatttttaaaaaattttttagtagagacagggtttcatcatgttgctcaggctggtctcaaactcctgacctcaagtgatctgcccatcttggcctctcaaagtactgggattacagatatgagccactgtgcctggcctctttttgaaaatagtcttactctgtcacccaggctggagtgcagtggaatgatctcggctcactgcaacctccgcctcctggttcaagctattcttgtgcctcagactcccaggtagctgggattacaggtgtgtgccaccacactcggctaatttttgtatttttaggagagatggggtttcaccacgttggctaggctgttcttgaactcctggcctcaacccgccttggcatcctaaagtgctgggattacaggcatgggccaccgtgtccagccaacaaagctttttttcagtgagtgattccagcccttgatgcataggagggtggggtccataggagtgtagccttaactgatgaattaaatctctgggtgatgtgagatatgtgccaggttcttggcttatgtctccctctagtactttaggaacttcccaactagatggaggcagtaaaaatgggccctgccaggatgtacctataacagagacgttcaaccatacccttgtgctgtctgcctttaatcacgaagattatgagctaagattcgtggatgcatttttattttttaaccaacatgtagcaatgatcactcagataggcatcttaaatccattagtttgggttggatttaagaccgttgtcattcctatgaaagggaagatagcccagattgctattgagaaggctttgtcagatgcattccagaaactgttgattgtggttctaggtaaaactttcttaatcgtcgttgaagtacttcagtttcagtgagcaaataaactcattttgaaaagttaattggataaaaatatcgatatctaaaacactccctaggatgctttcatttgctaagttctttcacagcgacaggctcaaatttgttctttgtgacatttgtagaaaaaatgacagcaaatattgtccctagtttatagctataaaaggacttgcctcaggtcacacagaaaatgtttgaggcaggtcttctttaattgcatgcctatcgtacagaatagtgattataagccctggacacatggatttgagtcctaactctgtctcttagatttttgtatgcagttttaggtcttatggccagagagatttgaagatatttaatatctctaagctgcaatctttatctgcaaactggggttagtaatccaatcaaccttattgctgatattgtaagaaaaaatgagatgacaagtgtaaaaactcagaactatacttacaaggtaagcagacaaaatatgctattgttgtgattgttttctctctgaataaataaactctgctgaagaatttattagattatgtttctcgaatcgagaattcagttccagctctcatttctggcactgacatattggccaaatatgattcttatacaataatcagctgctttgctgtgagccttggaagtggtcatgctgttgaatggcactgcttgtatttcctattcagttctacagtggcacaaatgtcatagcctgtgcccaaaggaaacctggtgtttaacgagtccctgaacagagttgcctttctgcttcacaaccctgaaggcttagagactgagattgtaattaagttactacagacctttatttgcttgtaagaggtggccctgattgctctcagctttccaacctgggcagcccttctagtgaaagtcttacttccttggtcatcaactgtcaagtctgagtaatgacatttaataaccaagctaaatgtgtgggttgtctacccctccctagtatgcaaaggtatcccttgcacacactcacttcttagaccaaaagccttatagttctagtttgccttgaaggaaattgtattgtctatagagtatgtgggccattttctgcccgtaaaatgttcaaatgttttctctctctaaagctttgttcattgtatctggtggaattttggttctcagggagtagacacctagccatgcttctaatgtgaagtgtctactagcccagtggtctctattttggatttgaacttacttcgaccccccacctggtgccttaccttttaatcatgttatgattgaacatttttatttccacattttttatttcttacgttattattccttagttcctatctgtaagatcataaagtcctttgaaccaaacacagttgatatttcatacatatgttaaaaactgagctgtgagaccagacatgatgactcacgcttgaaatctcagcatttcgggaggccaagacagaaggatcacttcaagccaggagttcgagaccagcctggaaaacaaagcgggaccatgtctctaaaaaagagaattagacgggcacagtgatatagtgcctgctactctggaggctgaagcaggaggatgacttgagcccaggaattccaggctacagtgagctatgatagtgccactgtactccagcctgggtgacagagtgagaccctgtctaaaagaaaaaagaaaaacaaaaatcgaagtgtatgatgaagagatgaggaaactttcaggaaaatgcttatttcctgcttttagaaactaaaagaatgtctcattgtgggttgctaccattatatgcaggaagttttggaatgaaaaagattctgaattcatccttgctaactttatttcagaaagtggtaaaatagctatggagtacagacccagtgaagagattgtagatgtcagatgggaagaagaactacacggtttaatataagtatgtggagataaaaactcaaaggtaacagggccgggcacagtggctcacacctgtaatgccagtgctttgggaggctgaggcgggtggatcacctgaggtcaggagttcaagatcagactgaccaacatggagaaatggtggcacatgcctgtaatcccagctactcgggaggctgaggcaggagaatcgcttggacccgggaagcggaggttccggtaagccaagatcacaccattgcactccagcctgggcaacaagagtgaaactctatctcaaaaaacaaacaggccaggcgctgtggctcacacctgtaatcccagcactttgggaggccgaggtgggtggatcatgaggtcaggagttcaagaccagcctggccaatatggtgaaaccctgtctctactaaaaatacaaaaattggctgggtgtggtggtgggcacctgtaatcccagctacttgggaaactgaggcatgaaaaccactagaacccaggaggcggaggttgcagtgagccgagatcatgccactgcattccagcctgggtgacagagcaagacactctctcgaggaaaaaaaaaaaaagaaaagaaaaacaactcaagggtttgataacattgccagtataaccataattcaaaacaagcagcagaatttggaggataatttgtttaattctcaggaaaatgtgaaactctgaaactgctttttgagtgcagggtatttccggggcttttcctaaagtcttaacccttggctctgaccccttatttgaagtttggagagcagaaccgaggattgtattactacagttgtggacacaggagaggggttagtctccccccgctccaggagtaagggatgctgggctgctcgaacacaggccttgttagaactcccttcaaacaggatcccagagatgtggggagaaggtaactggccttaagaatgattgcgctacagcttttgaaaactataatgcctttcaaatatggcttattgcttggatctcaatatctcccacgtatcttgggtggaatattttgctgaagatctttctgtcaatcatttacaatcatgtgctgcaaaatgaagtttgcgtcaacagtagaccacatatatgatggtggttccgtaagcgtataatggagctatccctatataggtataccatttttatctttttttttttttttttttttttttttttttgagatggagtctcactctgttgtccaggctggagtgcggtggtatgatcccagctcattgcaacctccacctcccaggttcaagtgattctcctacctcagcctcctgagtagctgggattatagacacgcgtcaccacactcagctaatttttgtatttttagtagagatggggtttcatcatgttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaatcacctagtgacccatttctcaagctcctcacgtggcaagcaatgcatgactgcatatgaaagctcttaaatagggattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataacaatagctccatccctaaatgaggtgaatcttggaatctcttccattttattttattttatttttttgagatggagtttctctcttgttgcccaggctgaagtgcaatgttgtgatctcggctcactgcaacctctgcctcccaggttcaagcgattctcctgctttggcctcctgagtagctgggattgcaggtatgcaccatcacacctggctaattttgtatttttagtagagacggagtttcaccatgttggttaggctggtctcgaacttctgacctcagtgatccccccacctcggcctcccaaagttctgggattatgggtgtgagccaccacacccggccccccttcaattttaaagccatcactatgcaccctatgtctatgccaggcactaaaataagatgaagcaccttcttggagtttacatgctggtaattatgccagacagtaataaaataggtaagaacggctgtgggggaagtcagctgggttctagttacagtcgcatttcaggaaatgatttaacatgctgactttaacaacctaagcctcttctccatgtgtgcacacagggtagatctctgaacacaggtgaccctagaagtgctgtaacttctaggggaatggctgtgttgagtcaaggcaggatgacagttcagcctcctcccaggctagtgcaaagggctcttcactcggattaaaaccttctctcccagaccgaattgccaactcccaacacccctcctacagaaaatgtggagtcctcgcttattccctggcagcccctacctaatagggtggtgaattaattatcaaacatgcgacagtttagcgaaaatggcaacactttggaataagtgactgtaatgtgcatcctggcgcccattttgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccaccccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtgacataaataaaggtgtcataaagacagggcggggctcacgcttagaaggggcacgagcgtctcggagctgccagaatgtcttctgctcagtgcccggcactagtgtgtgtcatgtcccggctgcgtttctggggcccatggcccctccttatgtggcaactattgtggctactagttaaggaggctcagcctctggagtgggtcaaggacccgctccagctcacctctaatcccctggggccgcctgactcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaagactccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactagacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcagtgatgatgctctaagtggttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttagcatatgtaggagagttggctgttcacatgattattcagtcctttagttttgtccagaactcatttttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggcgggcggatcatgaggtcaggagatcaagaccatcctggctaacatggtgaaaccccatctctactaaaaatacagaaaaaaattagccaggcatggtggtgggtgcctggagtcccagctactcgggaggctgaggcaggagaatggcatgaacctgggaggcagagcttgcagtgagccgagattgcaccactgcactccagcctgggcgacagagcaagactccatctcaaaaaaaaaaatgataggagggaagaaagagaataggcataaaaagggaggtatatataattaagtactaaaagataatgcagaccattggtgctagaatttgccagaatctgtgatccttgaggtgtggagatgctacatgggtaagctaaaactttacttgggtcttaaagagtagccataatttgttaaataggagaaaaatgggagtacagtctaggcaaacgcatggctacaggtatggttggaatttagtagaccaatgtggctacaaagaattaggtgagggagcaatgaagatacgattctgtaaaaccttgattatcagctacaggagtttgaaagttacacaatgaggtatggaaagccattgaaagtttccaagcaagagagattacatgatcaaaacaggaagattattttattttgttttttgcattatgtgcaagtgtagacatgcagaggattgttttagaatccatatgtaaagtgtccaaaaggaaaagcttaattcagggagacaaaatagaaaggtctagcaaaatctaggagtgaggtgtgaaggggccaaatcagatcagttgtaataggagtggaaagaaaaagcctaggatgtttcaacagagggcactgggccaaagctttggtgttacctggcatagggtttctttcttctcatttgttgataatgataagcttttgcccatatttctgtggaattatttaccattttggtactgatttgtagaagtctgtttagacacataagtgcttttagataaaatacttacattcaaagtaattaactggcatcatctgtccaagagatgggatggataagaagttaagcttccaggagatgcctcatcatttgtgccggtgaccccgcataatttcttgatgaattgtgcaaactgggaagctgatagctctggaaatgagaaagcaggtgttattttctgtttctgaatatccccaacaagattgcaatgattcttttacttatcgtgttcattgttttcctacctattcaaggatataaactgtgtttcttcacagaaatttccaaggaaactatatttcttacattgatggaaatgtatggaaagcatacagttggaccgagaaactgtgagtatattctctccaaatatgacaaaaagctaactgcattgtaagatccttcttggtccagaattttgaggtcggtacctctgaggaaagatatttctcctccacgccccaaatcaaccactgttgattgcaattgtatggttattttaaaattaaatttggtaggctctctttaaaataagaggcaatttaaatttattttttatcatacaaatagtacatggttatattcctttttgttctctttttttttttttttttttttttttcagagacagggtcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtattttttgtagagacagggtcttcctatgctgcttaggctggtcttgaactcctgggctcaagtgatcctcccaccttggcctcttaaagtgttcatattacaggcatgagccaccacccgcagcccatgattccatttttaatatataaaaatgcaataacagatataacaaaaactctccttgtgccctactccctcatccctgaagtaatgctactctgcatttagtatacatgcttccagacttttcctcatttacctacatacatatttacataaagcaaaatagatttgttttgtggttttaaaattttttcttcgcataaagggtaacatcttgcaacttgattctttcacttcatgatatgccttagatttctttccttcccagtactgagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctggaaatggaattcttggggtgaagactatgtagatataaaattttaattgccttcaaaaattttgtgccaacttactctattgtcagcagaatatgacagcattcatttcccaacaccttttcaccgctgggtattctccaactttttgctgaagttatggatgaataaaagggattccatctaaatgtgaatttttctgattactcatgaatttaatttagtatctttatatgtttattgaacatttgtgtttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattattccaatgtatatagacaagccacgatgagttctaaattaaaaataaacatatgctaggcgcggtggctcacgcctttaatcccagcaccttgggaggtaggcggatcacctgaggtcaggagtttgagaccagcctggccgatagggcgaaaccccatctctactaaaaatacaaaaagtagccaggcgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagggattctcctgcctcagcctcctgggtagctggaattacaggtgccctccatcacacccagctaatttttatatttttagtagagacagggtttcaccatgttggccaggctggtctcaaactcatgaccgtgggtgattcacccaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggcatgctagcaatgatcttttgtaacgatgtttacatgggtatctgcttcataattattaaactgaatattttggccaggtgaggtggctcatgtctgcagtcacagcactttgggaagcagacacaggaggatcacttgagccaggagtttgagaccagtctgggaacagagtgagaccctgtctcaaaaattaaattaaattaaatataaacaacatttatgttatgtgcactttatgcacattatagttctccagtttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataacagaatttggtgggaagaaacccactcttcaaggggtgtgcttgagtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtaaaatgaataaggggttcaaattagataatctctcagatttctttgagcaataaaattctgcaattctgtaagtttgtatagggtctcagcccatctctagcactagctacctcctgtgcattttcagtttttaagttgtatagacaaaatacagacaaaaacatttcacatggtaagaaaatctgagcagtgactgacacccatatgaaccttgttttataagggttcacatatcattctttttctattcagtctacaaccaatagatccaatctaatttatggtctatttttaaatagcccattaagttaagaatgggttttgcatttttaaagggactgtgaaagaaaaagaaaagaaacaaagaaatatgcgagagatcatatgtggcccataaaacctaaaatatttactgtctgaccttcaccaaaaaaaatttcaaaaagttggtttagtaggatgaaaggaactaaagttaacttcagatggttgcctaaaggagaagaaaatggagaccacctgcattcatttgaacatcattaatccagaattttttggtaatttaatcggaattaaattaacatttaaatattaaaaatagctgaattatatcaatattatcatcaagaatattaagctaccaagagaatagactggtattaaggatttcatttcaggaattgttatattaaaacagatgtttaaaatgatggttaactggtagagctagaaatgtttacactaagaagcacatcagaaatgcccctaactcttcactaattacaaaataacgatcgccccagccctgttaccaagaaagggatccctgtatttctgtctgtttagagacaagaagatactatgttcattgctatgaatgcttgattcttaccctttgtccatagaggtgtgtatgtcattaatccttattaagctcattagtgatgctcttttgcaaacagattctctcaaatatagaaggcttaaggaaagtgggtgtaaagaccctcaggtggatgccaaagtgctacagagaccatgaaataataaaactacgtttcctttaaaatagttattttccttctactcactcccccctattcatttattttacaaatatttgagtttgctttatttccatgtgtcagttttaaacatggtgggcaatgcagatgagcaagacctagtccatgctttcagggacctgtttatgctcagaagaaatgggatacaaaataactacattaagaagaagaaatggatgtgggcactaggagggataaattgtttctcgaacatagaagaggaaaaaatgccttcaatttggacccaggaggatgttactagaacaatgccatttgaataggactttaaagggccattgtgtaacaccagacagacatcttggggaaaatactctaaacttgcaaaaggaaaatgggagggcaaaacacaggaaagtattcaaggaatgccatgagtacccgtagagtacaagaagggagagtaggaaaatggagccagatcttctagagctttgaatgccaagctgaggagccaacatggggaaccgtgttaccacagcagcgctgtaaggtagatctgcatcacagtcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactagagatggagacatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagtgcagtggtgcaatcttggctcactgcaaggtccgcctcctgggttcatgccattctcctgcctcagcctcctgagcagctaggactacaggcacgtgccactaggcccggctaattttttattttttttgtagagacagggtttcaccgtgttagccaggatggtctcgatatcctgacctcaggatctgccagcctcggcctccgaaagtgctggattacaggcctgagccaccgcacccggcccgactattttttttaatattagaaattgtgtatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggcagggttaggggctctggaatgttcaaatacaagtccaaacgtttagagttgagatgaaaaacaggtattcagtattattctaaactcttgctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctttttgctattcttgaaatatgattaaaattttaccagtagaaagctactaaaattatacagcaaatcctttttgtctctagcaaggattattgtgagaattattacacagatcttagtgaatcatcagagagcagtggttctcaggtggtgtgattttgcactcaggtggcatttggtaatgtccggagacagttttggttgacaaaactgtgagtgtgctcctggcatctggtgggcaaaggccagagatgctgctaaacatccttcaaggtataagacaaacccccatggcaaagagttatatagtccaaaatgttgatggcactgaagttgtgaaatcctgttctagagaaataaagatcacttaacacaggtatttactgagcattcactgttttgtatctaatgcaccacatgtgcagtgttaaagtataaatcataagccagtatcttccacagtcagatttccttagtgcatagagaaaggattgaggttatgttccatcctatataaattagaatcatggcaaatgataaatgttctgaaataattttttttttctttggcttgtgtcttttttttttagaaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcatgtcttaagatccattcatttttctcaaatggggaagctaaggtacaaagaggccaagagacttacgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaaaaatctgggcgtggtggtgcagttttttgctccctggaggactttgtgttaagcttccttccttgcagctaaatgttgcagacatttaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcaaaacctcatctctactaaaaatacaaaaattagcaggtcatggtggcgggcacctgtgatcctagctatcgggaggctgaggcacgagaatggcttgaacccaggagggggaagttgcagtgagccgagattgtgccactaccctccaacctcccctccaggctggtctcgaactcctgtgacctcaggtgatccgcccacctcagcctcccaaagtgctggggttacaggtgtgagccaccatgcctggccaagatggtgtttatgttaagctattgtgcaaaaaaaaacttttgtaaagaaaatatatcgctgtatcttaattccatatactttcctgactactcttctaccataattgcaaaaattctatgatttctctgtataacatacccatcaaatcagagtgggtatattcagtggcctgaaggggactcaaggtgaagattctcctctacatctgactttagaaaagacgttccacctgccttgtggttcagaaatctagtttcacacagttcatttcaagttagagggaggcattcaggatgtgtctggactagagcagcagtttctgcacatgctcccctctgtcctcattaatttgctgatgcataacttaggaaaagtacactaaaggtctgtttttcttttgccctcacaccagagaacaggctcattaggtccctccaccaagaggtttaggtagcatcaatacaaatgttttaaactcaccatctttactaagcactttatacaactgggagtccctcataaaaatctggtggccgggagcggtggctcatgcctgtaattccagcactttgctgaggtgggtggatcacctgaggtcaggagttcaagaccagcctgaccaacatggtgaaacctgtctctactaaaaatacaaaaattagctgggcatggtggcaggcaactgtaatcctaggtactcaggaggctgaggcaggagaatcacttgaaaccaggaggcggaggttgcagtgagccgagatggcaccattgcactccagcctgagggacagagtgagactctgtctcaaataataataataatataataataataatcatcatcatcatcatcatcatcatcatcatctagccagcttcactacaattatgtaggcaacaccaggaaaacactggaatcacagttgataaaaattaatgaattcactcaaaaacattcagagtgtcatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggcccttttggagtcaaatcttcctggtaaacaaagctacactgcagtcatatttggcatatgtgacatataggcccactgcatttccttccaaaggcaagatgccaagggaaggtgccagtaattttatgaccaatatgacaccattttgtggtgtttgtaagttgaaacaatatatttccctgcattacacaagtttataaaaaacaaacaaaaaaagaggccccagctgtggttgatcgatgatgaatagagcctaaccttccaggcttctcacttgcacaggcccttccaaggtcgtgggagggcccctggaaatttttgtattcataatttttttaatgtttttactagataaggctcaggccccacaaaatcctgaaatcatccctgggttccaatagttacaacccagtaaatctcttgaatgaagcctctatgttattgacaaatactgactggccaagttagcagggtgatagggtctgtctattttgaatctgaaatccatctcaaagacaggccaagagcttattagtggacttaactggattctgctggcccaagcgcagtaaagtcaaacaaccatatcgaggttttgcattggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcacatattggcttgtctatggcacatcgatatcatgccaagaatgtaagcactaagagagaataagaggaaaatccaggctttatccctattgaattatttatcccactattagaatactagtgaggtaggtgtggccacactgtgatggcaaattgagcttcggtcacaaacatgccttactgttccccccagtctactgacatcagcttcctttacatagcggtagatgcacaaaagtttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcttcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgtagatgaggaagttgaaactcagagacgctaggtaatttgctaaggttcacacggctaataagtggcagaaccacttacaagctttgcaaataattttcaatgcagctcttagttcccctgtaataggagctgaatgatgacaatttggctttgtgtgcattgtatcttactttctaacttgaacaggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaacgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaggaaaaaggctcaccatttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatattgggtgagggtctaggtcatctgcttatttctttgactaccttcttccatggaaccagttttccctgacagccttgggattctagcatagatcattttggagtttgtcatttaaatttattttcacagcctgctttggacattttttcagctagagctgttaggatttcagtacatttaagacagtgatgacatgctccagtcctttcatctctctctcctcagttaatagaaaggaaacatagctcatctatctggacctgtacagaagaatttggagggaaaaaaaagaacaagcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctgaaaaaaagcttgccacattttacttccataaagataccaaaaaggcgatggactgggagtcagtgcaccttagtttaatgtataaaatgaaggacttgaaccagaaatggaaatggtcatctactgtgaatctaaaaacactcaaggctgggcgcgctggctcatgcctgtaatcccagcactttaagaggccaagacaggcagatcgcttgagcccctggagttcaagttcagcctgggcaacaaagtgagaccccaatctctacaaaaagacttttaaaaagtggaaacataaatataaataaataaaaacactcatatcatttggtttgtggaaaagagttgctgtagagtcctcaaacttgagccgttgagccagttcccactcagtctctccatggcccaggcacaaccttagtcaagaaaagaatgccttagaacaggaggaaaagaggataatatcgaatggccctatattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgccaagttgtttggctacatactgccttacagtcattatttttggtgtttagaaaaaaatagaaacagggtctcactttgttacccaggctggtctcaaactcctgggctcaagctttccttctgctttggcctcccaaagtgctgagattacaggcttgagatgctgtgcccagcctacattcatttttaatagctgggaggaaagtgggcagaggaagatatagaatgaaggggtagccgactttgtacagagcccaccagtggtcttacaagttttcatgccaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaaagaggagggggatcacaaggcaggacaagctgtgtggctcccagcctcgccactgactcactctgatcttggtcaagggagaatgaatcttcactcctcttttttccatctgccagcatgtttggtcttctggcacctggtgttctatacagtacaacatgcttctttgtgttacattgagacttgatccacgtaccatcaacgcagtattataaagtgtacaattcagtggtggttagtatattctcaaggttgtatagcaaacaatcaccattatctaaccccagaacattttcatcatcccaaaaagaaacatggtacccattagccatcactccccagtgctgtcttcccgcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatgtggttgtttctactttattttggcttttatgaataatgctgctatggacatgcatgtactactttttgcgtggacatgtttttaattctagggtgcatccctagcagaattgctagatcgtatggcaactcttatgtttaactttttgaggacctgtcaggctgatttccacagtggctgctccattttacacttccatctgcaatgtttgagggtttcaatttctccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatatatcttctttgaagaaatatttattcacatcctctgcccatttaaaaaattgatttgtctttttattgaattataggaatttctctatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgaaatttactcccatgtttttgtgtaagagtcttatcgttttggctcttacatttaggtatttgacatattttgcatcaattcttataatcgtgtgagatgtagggggtccaccttcattattttgcacatagatgttcaggtgacgccattacactcaagcctgggcaacagagtgagactccaatggagacggggtttcagcacgtttatcaggctgctctcgaactcctaacctcagatgatccacctgcttcagcctcccaaaatgctgggattacaggcatgagctaccatgcccagccaataaatgaaaactttttcactcaaaaaaacaacaattgtagtgaaaccatagatcagtttggagaatcatgctattattatctgcttcatgtttacagaatactccgttgaatttggtttgccagattttgtcaagcatttttccatctacattcataagaaatactggtctgtaattttttgtgtgtgatgtctttagtttggataccaggttaatatcaccctcatagaataagttaggaaatgttctttcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctttttatgtctctaagaacaatagtaatgtcccctctcatttctagttttaataatttggtcttctgtatttttgcagtgcagtggctcacacctgtcatcctagcactttgggaggctgcggtgggaggattgcttgaccccaggagttcgaggccagccagggcaacatactgagagcttatctctacaaaaaaaatgtaaaagttagctgaacgtggtggcacatgcctgtagtcacagctactcaggtggctaaggcaggaggatcacttgagcccgggagatcggtgctgcagtgagccatgattgttccactgcactccagcctgggaaacagagtgaaaacctgtcttgaaaaatgaacagtaagaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttagccgagtgtggtggtgcgcacctgtagtctcagctacatcttaattttataacgttgtagttcagattaattccaactttgtttcaatggtatacaaaaactttgcttctctaaagctccactctcaccccctcctttatactgttattgtcacacattacatctttatataccttatgttcatcaactagatttataattattgcattatgtaagtatctttttcttttttttttttttctttattttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccagccagtgctttttatttctttgtgcagattcacgttagtactccttatagggcaggtcttctagcaacaaagtctctcagtttttatttatctagaatatcttaatttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgcagtggtgcaaccactcacaacgttgcagcctccacctcccaggcttaagcaatgctgtcacctcagcctcctgggtagctgagactacaggcatgcaccaccatgcccagttttttttgtttttgtttttgttttttttaatttttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgactcttaacgagcatgctgctttcaagcatctgtttaacaaagcacatcttgcaccgcccttaatccattcaaccctgagtggacacagcacatgtttcagagagcactgggttgggggtaaggtcatagatcaacagcatcccaaggcagaagaatttttcttagtacagaacaaaatggagtcttctatgtctacttctttctacacagacacagcaacaatctgatttctgtatcttttccccacatttcccccttttctattcaacaaaaccaccatcgtcatcatggcccgttctcaatgagctgttgggtacacctcccagacggggtggcggccgggcagaggggctcctcacttcccagaaggggcagccgggcagaggcgcccccccacctcccggagggggcggctggccaggcgggggctggcccccacctccctcccagacagggcggctgccgggcagaggggctcctcacttctcagacggggcggctgctgggcggaggggctcctcacttctcagatggggcggctgccaggcgtaggggctcctcacttctcagacggggcggccaggcagagatgctcctcacctcccagacagggtcgcggccgggcagaggcgctcctcacatcccagacgggcatgcccagttattttcaaattttttgtagagacagggttttactctattgccagtgctggtatccaactcctggcttcaagcaattcttgagcctcaagcctcccaaggtactgggagtacaggtgtgagcaaccatgtccagcacctgcattgtttttgaagagaaattagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccatcatttcttcaaatattctttctccttttttctgtttttcttctcctgggacgctcattatgtgtatgttagtaagcttgatgatgtgttccacaaacaggtctctgagattccattcactttcattcatttttatttctgttcctcagagtcaacaatctcaattaaccttcaagttccccattctgtcttcagcctgctgtaatgtgccattgagaacctctaataatttttccatttcagttaccatacttttcaactctagaatttctatttgactcctttttatggtttctatctctttattgatattctctatttgatgagacattgctttcatactttcctttagttctctagtctacagaactgaatcgtttctcttatctctttgaacatattttaaatagctgaattaaatccttctctaggccaggcatggtcgctcgtgcctataatcccagcactttgggaggctgagactgaggttgaggctgaggccaggagttcaagaccaccctgggtaacttcgcaagaccccacctataaaaaataaaaaaatctttgtctagtaagtctaacatctggtccttctcagggacaatttctgcttatttctcccccaaccacgtgtttgggccatactttgtttccttgcatctttcataaatgtttgttaaaaattgaatattttaaataatataatgtagcaattctgaaaatcagatccatgctgccagggtttggtgttactcctgcttgtgttagtagttgctatttatttagtgacttttctgaacttcttctgtaaagtctcgcattatatgtcatgtgttcccactaaagtccctcctcggttagcttaccgatcaggtaatgattaaatgaagatttacttaaattcttggaactgataagtctcctagtttttgccaaggggctctgtgtacatgttggggcataccttcagcactcagctagacaatttacagccatgccttagctttcacttcttgcttgtgcagaacctcaaggtgtcagccaggggtgagagtttatgaacttagtaggtctttcctgaccatgctgacagtctgccctatgcatgcgcgtgacattccaaattgccaggaatatgtcttatggacttctagtttcccaagcatatatcagagtgtttcaaattcctgtggacatcttattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctggttggggatgtgggctgttttccaaggcgactactgagctagagggtgaggaatggtctaaggcaagttaacacaaatctcactgttcttacagaaattttttttgaataaatgctccttgggttgctgcaagactttggttacatttctagagttctgaaaaagtttattgtggtcaatttttttttttttttttttttttttttttgctattttttttggtatttgttgcttttatgaagggatgaatttttggatgtctctttttttttttttttttttttttttgagacagagtctcactctgttgtccaggctggagtgtagtggcataatctcatctcactgcaagctccacctcccgggttcacacaattctcctgcctcagcctcccgagtagctgggactacaggcgcctgccaccacgcccagctaatttttgtatatttagtacagacggggtttcactttgttagccaggatggtctcgatcccctgacctcgtgatccgcctgcctcagcctcccaaagtgctgggattacaggtgtgagccactgcgcccagcctgcatgtctttattccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgctctccagcctgggcaacacagtgagtgagaatgtgtctcttaaaaaaaaaaaaaaaagtctcattgaccatagactaataaactatttaatcatgggaaatgattaggggaaagacataaaaagagaaactgtaatccacttttttttgctctgtcgcccaggctggagtagagtggcttgatcttggctcactgcaacctccgcctcctgggttcaagcaattctcctgcctcagcctctgaaacagctggaattacaggcaagcactgccgtgccctgctaatgagaaattgtaattctcatagaggtcctcccagaggagtagaagaaggttgaaaggcacttctgtatttagtcttctcacaattaaggctgggcccagtggctcacaccagcactttgggaggccaaggcaggcggatcacttgagatcaggagttcaagaccagcctggcaaacatggtgaaactcccatctctactaaaaacacaaaaaatagccaggcgtggtggtgcgtgcctatagtcccagctatttgggagactgaggaaggaggattacctgagcttgggaagaggacgttgcagtgagccaagatcacgccactgcactccagcctggtcaatggagcaagaccctgtttgggtggggaggggaggggagtggaggggagaggagaaaggaaagaaaggaaaggaaagaaaatagaaagaaggaagggggagggaaggaaggaaggaaaaagagagagaaaaagaatgaagaacaaaaatgaaaattttttaaaaacctaaggttaaaataaaccctttttcttcatacagattaaacacgagttcaaattacagctttgctgcttaatagcttggtgacctaggacaagttatctaacctctctgtgcctcagtttcctcatttaaaaatagggcaataataatatctaccacataaggtatttgctgatcacaaatacctggcaacccagtagatactcactgtaataattattatttttataatttctgcctaagtacaaagatgattcttgggttaacctaaaggtagattttcttttatttcttcctgtttcttttatttttcttgttcaccttaaagaattaaaaagaaaatcgattccagcattttggaataaaaatttgcatcaaaatcaatttattcattttattgacatatgaacaaaatgtcatttgtttattcaataaacatttgttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaaaaaaaaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggtagatcacctgaggtcaagagttcaaaaccagcctgaccaacatggtaaaaccccgactctactaaaaatacaaaaattagctgggcgtggtggtgggtgcctgtaatcccagctactcggaaggctgaggcagaacaggagaatcacttgaacctgggaggcggaggttgcagtgagccaagatcgagccattgcactccagcctgggcaacaagagcgagactccatctcaaaaaaaaaaaaaaaaaaaaaatagatgaacaacttgaattatgatgagcaacttgaattatggaggatgctagaaatactgtttcctccacagtcagggcttcctaccaacatagtcacttttagggtttttgacctgaaaagttctgtggcatattttttctttgctatccactttttttttccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattccattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaactaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaagtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaatttttttttttgtttttgaaatggaatctcactctgtcgcccaggctgcagtgcagcggcatgacctaggctcactgcaacctccacctcccaggttcaagtggttctcctgcctcagccttccgagtagctgggattacaggcgcatgccaccacacctggctaatttttgtatttttagtagagacaaggtttcgccatgttggccagggtggtttcgaactcctgacctcaagtgatccgcctgcctcagcctcccaaagtgctaggattacagataagatccaccttgcctggcctcactcagcagaattttttttgagattatgctaccatccatgttgttgcacctatcactacagctggccctccatatctgcaggttcctcatccatagattcaacgaaccatggatggggaatatttggaaaaaataaaatatataaaacaacaatacaacaataaaagcagtagaaaatttaaaatacagtataattatgtacataccatttacactgtattaggtacttagagtatacctgaggctgtatacaaacattatgtcatttcataaaaaagaactcagcatctgtggactttggtatctgcagggggtcctggagccaatcccctgcagacaccgagggacaactgttcactcctttttattgctgagtagtattccggttgtgtggaaatgccatctctactaaaaatgcacaaactaggcaggtgtggtggcacatgcctgtaatcccagctactcaggaggctgaggcacgagaagtgcttgaacttgagaggtggaggttgcaatgagccgagattgcaccactgcactctaacctgggcgacagagtgggactctgtctaaaaaaaaaagtaagaaataaaaatgttttctgaagagcagaagtttttaattttgaccagctttaagttagcatttttttcttaaatggcttgtgattttttgtttcttacctaagaaatctttaagaacctgttgtctaatccagcgtctaaaagattttctcctatgtcttctcccagaaatgatacacatttaggtctatgatccattttgagttaatttgcatatgtgatgtatcttttttattttttatttttttgtagaaatgaggtctcagtatgttccccaggctggtctcggactcctggtctcaagtgatcctcctgcctcacctcccagagtgctgagattacaggcatgagacaccgtgcctggccttctttgcaggatatatatatagatatagatatatatataaatcagccaggtgtggtggcacacgcctgtagtcccagctactagggaacctgagtcaggaggatcacttgaacccaggaggtggaggttgcagtgagccaagatggcaccactgcactccagcttgggtgacagagcaagaccctgtctaaaatatatatatatttatatatatgtacgtgtatatatgtatatgtatgcctgcggggccctattgtgagtttgttacacaatttactgcaacttcaattgtgccaccagcccccacaatatggcaagctaaatagagactcagttatgctagggctggttgagggcattttgcaagattagcatggaaagggcccttcatttagcactctgctccgttcatttttgtcaggtcactttcttatcttgaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaaatgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagatttgtcagtatactttaaaacaatcctgggaacagttctagattgaaggagactaaagaatcatgtactaagtgtaatgtctgatgtttgattggattgtgaattttttaagccatgttatgattgggacaattgtgaaaatgtgtatacggaccgcatagtagacaatgataatatgaagttccattgagtgatgatagtcctctggttatgtcagagaatgccttggttcttaggggctgcacactgaagtcttcaatggtgaagggtcattatgtctgcaactgactctcaaatggttttgtccagaaaatgtatagacatacacacacggaaagctaatgtggcaaagtattagcaactactgattccagatgaaagttatacaggtgttcattataccatttgaaaatgtttcccagccatcctaaggcttaaaggaaaaaaagaaaatgtttaaaataaaaacttgggggcagaaaaagaataccaaaaattttgggctcatgcctgtaatcccagcactttgggaggccaaagagagagggttgcttgtgcccaggagttcgagaccagcctggacaacatggtgaaaccccatttctacaaaatatacaaaaattagccaggtgtggtggcacacacctgtagttctaggtactcaggaggctgaggtgggaggatcacttgagcacaggagacagaggctgcagtgagccaagattgcaccactgcactcagcctgtgtaacagagcgagacccggcctcaaaataaacaaaagaaacacctttgtggcagaggtaaggttgctatacaacaaaatgctgggttacggttccgggtccattccatatgaagatcagaggcttccactggacccaaaggaatactactagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactcactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatctttcatgacactggcattttttaagagtcaaagatagttgtcttgtaaattgtcccacaatccagatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaaaaaaaaaaaaaaattagctgggcatggtggtgcaagcctatactcccagctactcaggaggctgaatttggaggatcccttgagcccaggggggttgaggctgcattgaggtataattttgccactgtatttcagcctgggtgacaaaataaaaataaaaataaaaaataataattttccccttggtaattaataaataatctgtgggttgttactttgagttcagtgaagatcctgttctcaaatgttttttcacccaaatgtgcatcaatgataatccttgtctgaatgaatttgtattacactgacggttgcaaagtgacacttttaaaaattctgtcattccttctacatttactagctggcattatttcattgaagaagaactcctcctctttctttttcaatatcactcttcgtggattcttctttatattaaatatgtggtaacttattgttgttattcttttgaatgctcaaattgtccagatttgaccaatgcagtctttgttattttttaactccgcaatccaggttaaactaagctatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattccagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaacaataatacaaaacacacaactgcaagaaatgcctttgaagaaaatgattttatggaaaacactaacatgccagaaggaaccatctctgaaaacacaaactacaatcatcctcatgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccagctacttggaaggctgaggtgggaggatcacctgagcccagggaggtcgagtctagtgaacggtgattgcaccacggtacccaagcctgggtgacagagtgagaccctctttcaaaaaaataaaaaagaacctgtcagctactcacctggaatactggggttttgaatagttagctctcattctggttttttttttgtgtgtttttttttttagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttactgcagtgtatatttcaggatttttaaaggatcctcgctttcagatctctgtgaattgaaaccatgtgaatcccactagactattttaagaagtcgaaaatttctcccacccaaaactatgtcaacaattggatgtactcatcaagtcacccttactctgccactaatttatttccttgttgctgaaatgatgagagaggtataatctccaccctcacggagttgtcatcaccctggagaggaaggagagagccaaaagacatacgtattgtcttgtagacttattagatttacacagtatcgtcctccagtgtgtaaggcattgtctaaataggtccagttaaagcactacagagtagccatcttttacaaaaatttttggccacatttttaagttcactggtgagggggaacgtctcatactctagccctcctgagcctagaccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgccaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctagtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggcttaagggatcctcctgcctcagcttcctgagtggctgggactacaggcaggcagctaatttaaaaaatgtgttcgtagagacaaggtcttgctatgttgcccaggctggttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaaaaaaaaaaccaataaaaatacaaacagaaagtacaatataacaactgtcaacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtagatgagacttataatgaataaaaggaatcaatacagatttggagacggtggttgttgtcatagataatcttaattgcgttttcttctaaaacagatatgttgtcaccgaaggtcattacaagaagatgaagaaggattctcaaggtaaatattagtctggtgattttttttttcttctcttttgagacggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagagagggcacttgtctccttcaaggctgatggaaggtaggatatgtgagtccttcctcttaagtggcaggaaacagtattttctcttttatttcttttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaggaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtgagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatatgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatgaatgaaaattgtgattccgatgaagcctgccagagaaacaaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacactaaaaaggcaagagaagccctaagcagagtgagcaccagactccacaggttaagggctcagtcacacaggaccatccgcatgtcagaccccaggtgcaaggccaagcatcacctatgcatctgaccaactggctgtaaattggaggtccccacaactccctcctcaggtttgaacatttgctagaacagctcatggaacccaggaaaacagttttcttactagtgctgatttattacaaaggatattttaaaggacacaaatgatgaagccagttgaagagatacacagggtgaggtttggaagggtccttgtggagttggggtgcaccactctcctggaacatggatgtgttcgccaacccggaagctctccaagtcctgtcttttaaggagttttctggaggctttatcacgtaggcatgattgagctccagctctactccccacgccagaggatggggaatggggctgacagcacaacgcttccaaccataggtctttttggtgaccagtccccaaataaggagcccaccaagagtcacctcatgagaacaaaggacgcttctatcacccagaaaattccaagggatttaggagctctgtgtcaggaaccaggtttaaggaccaaatgttagaacaaaagatgtgcaaccataaaaaacagcgagatcatgtcttttgcaggaacacagatggagctagaggccattatcctcagcaaactaagacaggaacagaaaaccaaatactgtatgttcttttaagtgggagcaaaatgatgagaactcataaacaacagacactgggccctacctgagggtggagggtgggaggagggagaggagcagaaaaaactattgggtactaggcttggtacctgggtgatgaaataatctgtacaacaaacccccatgacacaagtttagctatataacgaacgtgcatatgtaccccctaacctaaaagaaaagtttaaaaaggaaaaaacacctaggagaaaagaaaaatgataaattaacaaaggacaatgctcttagcaccgccatcattcaggaatttccaagggttttaggagctttgtgttaggaactgggggcagagaccaaatatatatttcttcttatgttacactaccccagataggaaaacagaaattactctagatatttcaaacaaaaaagggttgtatataggcaattagtgcttatcactggaggtgctagaggtggtgaaggttgtggggatggggttgcaccactggctttcaggctactttaccacagctgatttccagaggatggaagaagtcaggaaacttgggaaaccgctgctgaggtccttgcagccccacggtccccaggctggtgactggtgggggagtatggagtccagctgaccaccagagcctgcacacctgctgctatgggggaggaaaggatgacttctacctcctttccacattccaaattccacgtgactacattttattggcagcaccccgctggcaagtgagccttgatgtgtgcttcctgggcttctggcacctgcacagaaaggggtgaaatgagtgtcacgagcagccaccactctgcatcacacctccacatccaggtgtgctggagagccccacttacacttggagtgtcctggtgccctacccacttttggtaggtgtttgggtgtctgaggctttgcaaaagaagaaggtggggagtctatggtggagtcacatggtggagacctagctaagtcagaggcctggagaggtgtcactggctgggcagcaggtaacacacaatcatcctgagctgattggagaaacacctgggattgattcagagttttttctggaatgttttcactggaatgaaagctgagcggtctgcaggccatatagtattggagaaaacttagccctcattgaaaaaggctgccagagaaaagatatccacagggaaattcaggagttttgtttgtttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattacaggcacccaccaccatgcccggccaattttttttttttttttttttctaaaaacagtttcaccatgttggccaggctagtcttgaactcctgacctcaagtgatccgctcaccttggcctcccaaagtgctgggattacaggcatgagtcactgtgccccgccaggaaattcagtttctgaaaatacacctgtggatctctagccttgaacacccttggatgctgctttaaatgactgatcctcgatgcctcccttctaactcacactcccctatatcaatctcccagaaaaagggacctcttttattcttttttttttttttttttttttttcagagacgggcctcactttgttgcccaggctggttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggcccggcgcctggggatgggaggcaggactgcaccttcacagggacgcttccaccctaccccggaggtcagggcctctcgcccagctctggctctgaggtcctggagggagggagatgctgttgcgactcagaagattgggggagggccacccccattcgagaagagtgaaaatcctgagcctgaagaagtggaaccggttggagccgaggctttagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactggcttacgacatgagagctcaatatgctccttatttaacgcactgttgtatcaggtccctgtgggagccactggctctatagcctaataaaggagcgggtgcacgcactggattggtgagctaccgccactgcaacgcgtcctaatcaaccatcctaaacggcggctggaacaaggttctcgcaggcctgtgcttgggcttgaacgctggtccagccgctgcgctctgtggctccctgtaggcctgcggatcggccagggggctccgttccttttgggcggaggctgaagaagcagcggctgcaccagagaaggccctctgggtgaaggtgggagcgcacggggcccgcggaaccacctaaggcgacttcagacgtgggctcggaactggcagcctttcgtttctgcttcattccaaggccagagcaagccacgtgggcaaacccaaagccaggggacaggaaagtatcctccacccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagcacatagtgctaagtatttggcttgtaatctgtagagactctgccatttggagctgggatctgtccccagagctgtcagacaccaaatcccgtatctactgccacccaaagggacctccagaagaaaggggttatacagggtcaaacaccaaggcaggttagtgaaatttctctagaggccatttaaagctggagtctcaccacctgaactgccctcagaggaaggctgtctagggcacaaacctagtcaggggtccacatggacttaaggacaatttttttttttttttttttttgagacagtctcattctgtcatcaaggctcgagtgcagtggtgtgaactcagctcactgcaagtctcaacctcctgggctcaggtgatcctcccacctcagcctcccgagtagcgggaaccacaggctcgtgccatgatgcccaattaattttcttttaaattttttgtagagatgaggtctccccgtgttgctcagtctaatcttgaactcctggactcaaatgatcctcctgcctctgctcctcaaagtcctgggactacaggtgtgagccaatgcacctggcctcttatgaataattttaaaaacaatgaggttcaccgtcagagcccctgctgctctaccaagtcccttggcccctctcaacagggcaaaagcaagatgagccccagatgttctgcttaatgaccacctttcccaggagactttgctctttaaaggagaaccacttagagatatgagcaaccttaaagaatgccaccagcactagtgaatgccaggcacgggccacgtgggtggagagtatactttagggcagtcactcatggtaaattatttccaccagcccccagaagtgactattcaatgtccaactatgtcaggcccaggctaataaaagtagaggcatgaggaacctagggttgttctgaagtgccttgattatggtacatgtggaagattttagagcttgttgtaaaaagtgatgacccatggccccccaggctgggtctgggattccctttgtggattacaagaggatattatacagcagtttttaaaaatgaggcagactgggacaatctatctccaagatgcataggtgctgttaagggaacaaagcaagatttagtagggcgtgtatagtatgctactgtgcgctgtgcgttatctgtacagaactgtgaggtctgatacagtagccactagccacatatggctatttacatataaatttaggttggccacagtggctcatgcctgtaatcctagcactttgggaggccaagtgggaggatagcttgaggccaatagttcaagaacaccctgggcaacatagtgaagccccttttctacaaaaaatttatttatttatttatttttattttttttgagacgggtctcactctgtcacccaggctggagtgcagtggcgcagtctcagcttattacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttaggaggctgaggtgggaggatttcttgagcccaggaggtcaaggttgcagtgacctatgactgcaccactgcactccagcctggacaacagagtgaggccctgtctcaaaaaataaataaataggagtttgaggccatgttcacacatcactgcagtccagtctggtaaacagagcaagacgctgagtctttaacaaaaaaaaaaaaaattttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaactggtaatggcggttgccttccgggagggaaactgggagagtgcagggctgtatgcccttttgtacctcttgaatttcatatcatgcgtttgtactaggtgtttacaaattattttaaaaacatactgggaattaggaatccccatatggaatcactgcagtgggacactgattcccaaaaaattactttgcaatttgcctaaaacaaattaagctaatagctatcatgatttcatatttaatattttttcacagcttagagtttttttagctcctgttgctatctctctgctcttatgagctcacagggtgacaaagtgaattagtaagtagcaggagaacattaaaggaaaaactcctgggcaacagggcaaaacgccggctctacagaaaatacaaaacattagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagatatgagccactgcatccaactttggttcttgtttgtctgttttgttttgttttggtttgtttttttgacagagttttgctgtgccacccaggcagtgactcagcctcggctcactgcagccttgaccttctggcctcgagtgatcctcccacctcagcgccaccccccactgccctccaatatctgggactacaggtgcgcgtgaccgcacacagctaatttttaaattttttgtagagatagggtttcactatgtggctcaggctggtctccaactcctggactaagcgatctgcctgccttggccacctcccaaagtgtgagccaccatgcccacccattgaacattgaagctagactgggcaaacccttaagcctaaaccagtaacagtttttcacaagttcatagatgttactgtggttaataacacacaaattcatttaaaagcatgtgtgtccacatagtaatttttggtccttatttttatttttatttttcagttaatggatattaaagatacaactttattttgttttttttgagacagggtctcactctgtcacccaggctggagtgcagtggcatgatcagagctcattgcaacctccacctcctgggttcaagagattctcctccctcagcttcctgagtagctgggattgcaggtacatgcaaccacacctggctaatttttgtactttttgtagagatagggttttaccatgttgctcaggctggttttgaactcctgagctcaagtgatccacctgcctcggcctcccaaactgctgggattacacaagtgagccaccacacccggcctaaagatataatttctatcatgaggaggtccaagaactattctctttttctttttttaatgttagaaagggattaactgggtatgtgctgcagcaaagggaggggaaattaagcaagaagagaagggagccaggaaataaaggccccaacccaggaagcagttaagcaaagttccaggatgacccatgtgacaagtttaggggataacttgagcacatggaggacagaacttggagagggcactgtgggcctgggcgccacctgctccgccagagcactggaagagaacgagggcacgataatggcagatggcactgaaagaaaaggagagagcttgaggcacccttgggggaagcagccatcatcagagtgtattttatttttattttattatattttgagatagagtctcactctgttgcccaggctggagtgcagtggcatgatctcggctcactgcaacctccacctcccaggttcaagtgattctctgcctcagcctcccaagtagctgagactacaggggggcaccaccacacccggctaatttttgtatttttagtagagatggggtttctccatgttggccaggttggtcttgaactcccgacctcaggtgatccgcccaccttggcctcccgaagtgctgggattacaggcgtgagccaccatgcctgacctcacagcacattattaagctctgtggtgaataatatttatatagtcacaattctgtaaacactgttcattttctacaaattgtggcaaacccaaacctcaagaatggacagggctagggtgtaaaagagctaagtccttgccaggtttaccaggaaggcaacagacagtgtctaaaactatgagacagctgggcgcggtggctcacgcctgtaatcccagcactttgggaggccgaggcgggtggatcacgtgaggtcaggagtttgagatcagccttgacaacatggtgaaaccccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaaggagaaaaatatttatccctaataactaatggaccatcttacgccgtctataaaaatatcaattaagaaatcacggccgggcacagtggctcacgtctgtaatcccagcactttgggaggccgaggcgggcaaatcacttgaggtcaggagtttaagactagcctggcaaacgtggtgaaaccccatctctactgaaaatataaacaaattagccaggcatggtgacgggcacctgtaatcccagctactcgggaggctgaggcaggagaattgcttgacccaggaggtggaggttgcagtgagccgagatcacaccacttcactccagcctgggtgacagcaagactccgcctcaaaaaacaacaacaacaacaaaaaacgcggtgatacacgcctataatcccagcactttgggaggccaaggcgggcggatcacaaggtcaagagatccaagaccatcctggccaacatggtaaaaccccatctctactaaaaatacaaaaattagctgggcatggcgcgcacctgtagtcccagctacttgggcggctgaagcaggagaatcgcttgaacctgggaggtggaggttgcagcgagccgagattgtgccactgcactccagcctggcgacaaagcgagactccgtctcaaaaaaataaaaaagaaatcagaaactgttcaaattccaatctatacaagtgaaacctacacagttaaatgtcttaatagagagctaaaagcattaagttctgtcatactcaacatactgatgaaaaaaatttgaactaaaagacagcctgatctttagaaactggcagaaaaaataggggctgcatccaagaccactcacggcacgtccattcttccagcagctcccaactgctattttatgaaaagtccaaatttcccaccccaaggtcctagagtacagccagctccctaccatcaaaaacaatagctaccaaaactcagtaaaattaggcttgttatgaagagaagattgaagaaataaaggtatttatttcatcttggtatttgaatgtggaaactcccagtagggtaagaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaactctctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctctcttctacaaactatatttcagggaaaccaaatatttgatgagggaattctttgtttagaaggattttagctaataaatgcagaggaataacaagatttaggaggggggagaaatcaccattttgtgacttctaataaaataatgggtctaggcaacagttttcaatggatgctaaaacgattaggtgaaaagttgatggagaattttaattcaggggaattaggctgataccatctgaaaccatttggcatcattaaaaatgtgacaacctggtggctgccagggaggaaggggagagggtgggggaagaacagaagttatagtttatgggcacaaagttttggttttacaagatgaaaatagttacagaaatgaatggtggtgatggttgcagaatattatgactgactatacacttaaaaatgtttaagatagagctgggtgcagtgttgcacacctgtagtcccagttatgcaggaggctgaggtaggagaaccacttgagcccatgagttcgagaccagtctgagtaacatatagagacctcatctcacaaaaacatcactaccacaaaacaaaacaaaacaaattgttaagatgctaaattttaagttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaaaactagccggacgtggtggctcacgcctatagtcccagctactcgggaggctaaggcaggagaatcacttgaacccaggaggctggggttgcagtgagccgagactgcaccactgcactccagcctggccaatagagggagactccgtctcaaaaaaaaaaaaaaaaagaaaagaaaacatagttacccagcaattccacttctaggcatatacccaaagaactcaaagcagggactcaaacagatacttggacatgaatcttcatagcaacactattcataatagacaaaaagcagaagcaactcaagagtccatcgatagatgaatggataaacaaaatgtggtatatccataaaatagaatatcattcagccataaaaggaattaagttctgatacatactacagcatagatgaaccttgaaaacattgtactaagtgaaagaggccaggcagctaaacttccaaagactaatatacaattccactgaataggcaaattcatagacagaggatagaataaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaagaataaacttgtaaattttatattatatatactttgccacaataaaaatttttttaaaaatgtctaagtgtgacaaccgaacttctgtgttaggataggaagaatacttatgaagtattcttgcccctgaaatgaaccaaaatctaatcaagtctctagaataaacaaccagttcacaggaaatccacagatagccaagcaagttagatggcactataataaagtaatcaaccaaatccagaatgtggaataagcagttaaaaaaaaaaaaaaaaagagggggggaggccaggcgaggtggctcacactatggtctcagcactttgggaggccaaggtgggcagatgcttgagcccaggagtttgagaccagattgggcaacatggtgaaaatccatctctataaaaagtacaaaaaaatttgctaggtgtgatggtatgcacctgtggtcccagctacctgggaggctgaagtcagacaatcgcttgactccaggaggcagaggttacagtgagccaagattgtgccactgcacgagaccctgtctccaaaaaaaaaaaggaaaaaaaaaggcatagagaaagaacaactgctgtagaataaaagactaaagaggcaaaacaacaaaatgcactgtgcgaactctgatccagatgcaaacaaagcagatgtagaaaagatgtagaaaggatactttttttttctcttttttttttttttttttgagatggagtctcgccctgtcgcccaggctggggtgcaatggcgcaatctcggctcactgcaacctccgcctcctgggttcaagagaatctcctgtctcagcctcccgagtagctgggattacaggcatgcaccaccaagcctggctaattttttttgcatatttttagtagagacagggtttcaccatgttggccaggctggtctccaactcctgacctcaggtgatccaccagccttggcttcccaaagtgctgggattacaggtgtaagccaccacactcagccaggatacatttgatacaactggagaaattagaataaggactaggtgctagatattaaagaattattattaattttggagatgttataatagcatgaagattttatatatatatatatgccttatcagttggaaatgaacactaaaggacatgtgaataaaaggcatcatgtctgggatgggcaaaatgcttataactgttgaggcttggtgatgggtacatgggggttcgttatgttatcctctctgtctttgtatttgttttagattttccactaaaaaagttaaaaaaataaatgcactactttgagaaaaaacattctaaaatctatagcctggaaaagataactgcaaatagagttaattgccaaaggtaacagctaaaacaatgatataaaatataaagggacagtcgacttgggtatttcatctggaaagactgacgaatatgtaagtctttactatcaagtacatgcaggagaatctccaaaacaaacagactccaaataaattctaaaatgagaaatttgtagattccatatggttaatattttacatgaaaatcggggtgtaaaaactatagtcagccctctgtatccacagattcaacccaccttgaaccaaaaatattaaaaagtaataacgcaagccggacacggtggctcacgcctataatcccagaactttgggaggccgaggcgggtggatcacctgaggtcgggagttcgagaccagcctgaccaacatggagaaaccccgtctctactaaaaatacaaaattagccgggcgtggtggtgcatgcctgtaatcccagctactcaggaggctgaggcaggagaaccacttgaacccgggaggcggaggttgtggttagccgagatcgcgccattgcactccagcctaggcaacaagagtgaaactccgtctcaaaaaataaataaataagtaaataaataaaaataataacgcaacagtaaaaaaaaaaaatacaaataatacagtctaactatatagcatttacatgctagtagacataagaagtaatctagtagtgatttaaagtagacaggggggctgggcacagtggctcacgcctataagcccagcactttgggaggccaaggtgagcgaatcacctgagatcagaagttcgagaccagcctgaccaacatggtgaaaccccatctctactaaaaatacaaaaattggccaggcgtggtggtgcatgcctgtaaccccagctacttgggaggctgaggcagaagaaccacttgaacctgggaggcggaggttgcagggaggcaagatcacaccactgcactccagcctgggcaacagggcaagactctgtctcacaaaagaaacctccccagtaagtataaagagaccctaagagaggaaatggctgacagtgtaaatagagcagagcaccagaaggtatcacttcaagcatccgtctttagagacatttcacagaaacagtatcgaggctacaaaccgaataatctttaccttttgtgttctggaaaaaatgctgccacagaggtctgattttgaagtggctgccaacatcccagacagcgaaggtgttatttttatattctactgtctccacacagaaacctaaatgaaacatggggaaaacatttaattatgatttgtgctggttgaacaattcaaaataatttcaacatgcggacagtacttttaatttacaaagcagcctgctagtcaaagatctatagccttcaaacagaatgtgctggccccctcgcccattcatcaggacaggtgtctcaaaccttctctactctccaatctctagccacgcacctgccctttctctcagcaggagactatcacagtgtacttcagagcagagaagccgccgatgggaatgacttccacttccaccatacagtgtaaaagccagtctacatctttacccatgcttttcttcctccctcttggaacaacagaagaaggtaactctcttccaccaactccctccctctatgagccagatccaccctacccagactgtctggaactttttactattcctattctctcccatatctgaatatctccaatctgttcaccttggcatgcttaagccttttacatctttaaaaacaacaaaacaaacctttccttgatccccacatcttcatcgcactctcttccttcacatcttcaccctctatttgctttttttttttttaagagacagggccttgctgtgttggccaggctggagcacagaggtacaatcatagctcactgcagcctcaaactcctgtgctcaagggatcctcctgcttcagcctcccaagcagctagaactataagcatgagccaccatacctagctaaatttaaaaaattttttgtagacacagggtctcactatgttgctcagattggtctaaaactcctgaggtcaagcaacctgtccactaagctttcttcggtcctctcacgcaacagcaccttagctctgctccaccattgggtagctggttttcagtaaggtcagcagtgatcaccaggtcaataaatctaacacaggccttctcagttcttccataatttgatcttctatctgacgctactgctcactccctccttgacacccttccccagcttcccttttccttctatctctatggctgtactgtctcagtctccttagtgaactcagccacgtttaactgatcctgcaatgatgggagtcgccctggctctcactggccccatccactctcctctttctgcacccctccctaggcaatctcactcactcccacgacttcattcctatctctgtactaactctgagatttatatcccccaacctagccctctctcctgagcttcaggctcataatctaacagctttggcaaatgtcttcaaggccccaaaacaaggtgatcagtcaaaaatggaatttaaggtccctacccccaacctcctcctctgctagttatcccatcattgacttcgttccacaagctgatagcctgagaggtgccctggaaacatccgatgctcgcacccctagaaccctactaccacaccttatcaattcaaccccttcaacaactaatagtcaccctaacccaacagaccatcatttctagcctcaattcctgaaaccatataactaatttcacctcagccactctccctctctccatccggtcaccatcttctaaacaaagcaatagcttaaaaacacatagtgtggtcacgtcatttctctacacatttatgtttgattggaatattttcaaacttaaaaaagaaagaataatcgccccaaaaaataaaattaaaaattaaaaaaaaaagaaagaataagccgagcacagtagctcacacctgtaaccccagcactttgggaggctgaggtgggcagattgctttgagctcaggagtttgagaccagcctgggcaacatggtgaaaccctgtctctacaaaaaaacacaaagattagccaggcattggtgccgtgtgcctacagtcccagctacttgggaggctgagacaggagaactgcttgaagcaaacattgcagtgagctgagatcacaccaccgcaccccagcctggatgacagaataacatccaagaaagaaaagaaagaaaagaggaagagagagacagagagagagagacagagatgggaggggaggggaggggaggaaggaaaggacagaaaagggagggagggagggagggagggaggaagggaggaagggaggaagggaggaaaggaaaagaaggaaagatgtccccttagcggcttcccacacccaaatcccaaacatgactgtcaagacccaagcaagctgggtctgctcaccttccaaacctcaattctagtcatgccttattttagtgagagacactcgttacattgcaacaatctaaattcttgctaaataaataaatacaatgccattccaatcctataatgatggtaggggcaggggcaggaaacttagcaaaattatctaaaatttaacctggagaaataaacaagtaagcataaccaggaaatctctgaaaatgagtaatgaattatttttaaggatatgccaagccctagtaacacttgaatagagttcaaatataaatgcaacaggtacttgcccaaaaaaagacacacataccagtgagaatttagtatgtaacaaagaaggcatttcaaatcagcatggaaaaattattcaataaatgacattgaacaactgtctaccccagcaccgtccaatacatagtcactagccatttgtgactatttgtttatgtttttgttttattttgttttgtttttgagacagagtctcgctcttgtcacccaggctggagtgtatggtgcgatctcggctcactgaaacctccgcctcccggattcaagtgattctgctgcctcagcctcccaagtagctgggattacaggcgcctgccaccacgcccattttgcaattttagtagagacggggtttcaccatgttggccaggctggtctcgaactcctgacctcaggtaacccgcctgcctcagcctcccaaagtgctgagattacaggcgtgagccaccatgcccggcctatttatttattttttgagacacagtcttgctctgtaacctaggttgaagtgcagtggtgcaatatcagctcactgcaacctgtgcctcccgggctgaagtgattctcctgccttaacctcccgagtagctgggattacaggtgcatgccactactaatttttgtatttttagtagatatggggtttcaccacgttggccacgctgatctcgaactcctggtctcaagtgatcttcccacctcaacctcccaaagtgctgggattataggcataagccactgcgcctggcaacgtggctatttaaacttaaagttaaaatcaaaaatcaatcaataaataaaaataaataaaaaataaacttaaagttaaatacaattaaaagttcagttcccggctggacacagtggctcatgcctgtaatcccaacactctggggggccaaggtggacggatcacccgaggtcaggagttcgagaccagcctggccaacagggtaaaactccgtctccactaataatacaaaaattagccgggtgtggtggcgtgcacctctaatcccagcttctcaggatgctgaggcagaagaatgacttgaacccagggggcggatgttgcagtgatctgagatcgcgccactgcactccagcctgggtgacagagcaagattccatctcaaaaaacaaaaaagttcagttcctcagttgcattagccacatttcaagcacatgaacagtcacatggctattggctacgacactaaacagcacagacacagaacattttaatcactgcagaaagtgcctcctgggcagcactggcttatccatttgaaaaatttaaccaaattactaccttacacacaaccatctcataactcgaacattctcctcggtttcccactcctcaatcgatgcaatctctgcagctactgcccaagttgaaagttgatcatttggagaccaggtgcggtggctcacgcctgtaatcccagcacttagccgggcagatcatttgaggtcaggagttccagaccagcctgcccaacatggtgaaaccctgtctctaccacaaatacaaaaattagccttgcatggtggtgaacgtctgtaattccacctactcaggaggctgaggcatgagaatcgcctgaacccaggaggcggaggttgtagtgagccgagatcgcgccactgtacttcagcctggggtgacagagcgagactctatctcaaaaaaaaaaaaaaagaaagttgatcatttgagtcctgtgcctaattcaatattcagaacagaacagtagtaatgttcacatgccacctgtggggtgtatcctcagtcagaagtttggatctagaggcagttcacaaggcaaagattcagttctgtcaaaactcgctttgtaaatctcttaacaagccggtaaaacacagtgctggttcacagtaagagcagtgcagccagcttgtctatttctctagttggacatcatctcaagcagttggtttgagccagagtgaagaaaagaaatcacactccatctctaagcactgggagcgtacttggtgtagagatgagatgctgccactaaggaaggccagctggaacagaggctgactgaggaggcaccagcagattcccagctcccacctcagccttctgctgggacactagctgcgaggaatgaggggcagaactaccctccctgttttgcccattatctttttcttttttgccaagcaaatggggttaaatttgcttagcctccatgtgttcacatgtctcccttgtgaacctaagaatgtgcaagccactagaaaaggatacataacctggccaggcgcggaggctcatgcctgtaatcccagcactttgggaaaccatggcgggaggatcgcttgagcccaggagttcaagaccagcctaggcaacatggcaaaaccccgtctctactaaaaatacaaaaattagctgggcatgctggtgcacgcctgtagttccagctactcaggagggagatggaaggatcacttgagcccaggaagttgagactgcagtgagcagagatgtaccactgcactccagcctgggtgacagagtcaaaaaaaaaagaaaaggatatatataacctggtttttggcctctaaaaatgtatgctcatggagtagacaagatttttaaaaagaattattcaataacataagaagcatgtaaaaataaaacatatttctctggtgaaacagaacctaaaaaatatatataacatactaaattgtaaactggaattgccacaggtctttcattaacttacctactgtagggacggcaggcacagtctcccccagcttcaatttatacaagatggtggtttttccagctgtatccaaactcaatataagaatccgcatcttttttttcccaagtagacttttaaagagcttttcaaaaatgtttcccattgtaatttaatcgaattctgtaacatgacaagaaaagcaagccaaataattgttctctgcagagatatagaagcaacacgcagaaaatacaagtgtcaattagaaatggctcccaggaaaaattcaacaattttaggtacactttggccaatgagtagtgagtcttgtcttcaaagggaaactcaactaaacctttccatgccttaccagaaaattctattttccactgcagcatccaagagggatatgcaacatagcctcagcactgctatgacagtggcagcctttagtcatttagtacagaagtacaaggccaggtgcggtagctcacgcctgtaatcccagcactttgggaggccaaggtgggtggatcacctgaggtcatgggttcaagaccagcctggccaacatggtgaaaccccgtctctactaaaaacacaaaaattagctgggcacggtggtgcacgcctgtagtaccagctactcaggatgctaaggcataggaatcacttgaacctggggaggcagaggttgcagtaagccaggaccacgccactgcactctagtctgggcaacagagcaagactgtctcaaaaaattaattaattaattaattttttttaaaaaacaagtacagaagcaatgatacaacaaatacaactatacctcattctaaattctactgaaatgagaatttatgaaacagagaagctttttattttatgcaatataaaacaaagtctttaagacaggttaaacaacaatatcccttggaaacgtagtagttccttatggctagcagacaccttggaaataacctaagaaatttcagaggcaaagaaattcagcgttgggaagcttcactgccaagagagataacttggcagagttgaggaggcaccacagcatccagttttcgtttgagttttttgttttgttttgagacagggtctcgctctgtcacccaggctggagtgcagtggcacaatcacggctcactgcaacctcaacctccccatctcaaacaatcctcccacctcagcctctggagcagctgcgaccacaggcatacgccacctcgctcagctaatttttgtattttttgtggaaatgaggtctcactatatttcccaggctaatctcgaacccctgggctcaagtgatcttcccacctcagcctcccaaagtgctgggattacaggcgtgagctaccaggcccagccagtatccagtgttctattgctgtaactatcaccttactctcaaccagttcttagaactttttatttaagtataatttacatacagatataaacatacatgataactgtaaagttcaatacattttcatgaaccaaacacacctatgtaaccaaatcaagaaaagatgatttatcaggctgggcacagtggctcatgcctgtaatcccaacactttgggagaccaaggtgggtggatcacctgaggtcaagagttcgagaccagcctggccaaaatggtgaaaccccgtctctactaaaaatacaaaaattagctaggtgtagtggcacacacatgcagtcccagctactcagaaggctaaggcacaagaatcacttgaacctgggaggtggaggttgaagtgagccaagattgggccactgaactccagcccagggcaacagagtgagactccatctcaaaaaaaaaaaaaaaaaaaaatgattatcagaccaattctccttgtgcctcctcccagtcattactccataaaaggtaatcactatattgacttctaacagcataaatgttcaatattttatttttcagtagaaatcatggtaggttatataaagtaagtcaatagtaaagtcagactaacttacagaaatttacagtctctttgagatcagcctacttgaaatgtgagcttgacattctaagtaaagacttacaagcagtgctgggtctacacctctaactaagctcttggaagtctgtaaagatcttcagaccaggcagggtggcttacccctgtaattccagcactttgggaggctgaggcaagagggtcactttagtttttgcttactgagataacagaagacaagggaggattgctttaggccaggagtacaagaccagcctgggcaacatagcgagaccctgcctctatttttaaaaataataaaacaaaaaaaaattcaaaaagaaaaagacatacatccttgttccagagactgtgatttattttctttttaaattgctaaccaaagaaagctttactcctgggcaggggaggaggaagacacaaggaggatagccaatctcccattcattcggactctggtaaccacagagcggaggtaaccaaattccacaggcctcaccgctgaaattcaacagtggccagcagtagcttaatatcatggattacgcccaagtacacaacattcctttctaggatgagagaaagcgagcacagaatttatcctgttcacaaatgtggcgtaagtgaccaaagaatgataaatgttttaatcattcaaagaaagtccattataggtctataaaagtccagtgcattgcagcactcaaaatcttgccgggcgacaaaactagagattccttttctttgtttcgaaaaacaaatctcacagatgaggagacttttcaggaacatgctgggggagggaaggtacttcccgctcagatgccccttgaggcagctagtcccaattccccctgccaaccgcacagacacaccaccttgacctccctctcccttctctttcctcttattgctactcatgtgccccaggcgcccgtggtcctgacacccctgcgccgctggagacccctctaaggtaagatggctccgactacagggcctttttggcacgctcagtctcccagccccaagcgccaaaagtgcattagggagaaacgtcggcacgacgtcaagggcgcgaacaagcgtggtggcccaggtgagcgtgcgcggcagccaggcacgcccggctcccggggaaagacgccccttttttgccccggctgccaggccgctccttctcaacttgtgcgcccctggaagagcaaagagagggccctgcgtggaacctatgaagcctccttcggttcctcgctgctccggccctagagagggcgaagaaggaacagcggagcccaatccctttccgaaagccaccgccgccctccagtttctggcccgcagacgaagtggagatccagccaggtcttgagtgctgccgccccatccctgcagccggagactcacctgttgccactcaaggtaccgctacctacaacaccgccgactccgcggcctttaggatttcagctcagttcagctaaaccacgacaggcgtgggggcaggaacagcaaccaaccaatcacccaccgcctcctggagcttttgcaccaatgagctcgaagttttgtgagtgacgacatatctggccaacgcaaagaagagtaagggcctgggagggagggagcgccgtaggcgacgccatgaagctctggcaataccatgttcatcttcaaatcacagttaaacgaattctggcgagacacgcccacgtcccccacccccgatgccatgtgcgaccaatcagaaaagcaaaaggattgtctatttgcacggccaatcagctgggaaaatcgccgaggtttgagctaacctcggagcgttcacaccaaccgggaggggacatgtgggccgggccaagttaatagtgccatggaaggaaatttaccgcggttgagttaaacgtagacattagtttggggcggtgttccgcgtaggaaataccacacactgacactgaaattaggcataaggaagttttcctattccgcctgaggctagactgccctcccacctctacacagattttcaagttggggaaaatactggccacccgcacctcgttaagacgtcgcagaaccagtcctcgtttccgagaaatgctttctatagtcagttccctaaatgcccaacttgttagctaaaaaggttacaaacgcctgtaaatggtacataactgaaatcatcagaacaacaaacatctattaaacatatactatgtgccagaaactatatcaagaacttcagcaggcccggcgcggtagctcacgcctggaaggccaaggctttgagctaggagttcgagaccagcctgagcaacatggcaaaaccccatctctgcaaaaaaaaacaaatttaaaattagccgggcatggtagcggctgtagtcccagctactcgggaggctgaggcaggaggatcacttgagcccaggaggtagaggctgcagagagccgtgatcacgccactgcactccagcctgggtgacaaagcgagaccctgtctcaaaaaacacgaacaaaaaaagttagaagatactgctagaattgactaaataaataaataaataaataagaaaaacaatgttacctgcaggaccgtaacgcccagtgaattacaaactattatccctggccagacgtggtggctcacacctgtaattccagcacactgggaggccgaggcgagcagatcacctgaggttgggagttcgagaccagcctgaccaacatggagaaaccccatctctactaaaaatataaaattagccgggcgtggtggcacacgcctgtaatcccagctacttgggaggctgagacaggagaattgcctgaacctgagaggcagaggttgcagtgagccaacatcgtgccactgcactccagcctagacgataaagcaagaccctgtctcaaaaaaaaagaaagaaaagaaactattatccctgctgttttacagaaaaatattaagtagcctgggtctgtcccactcccacaccttaatctttttctttctttttccttttttttttttttttgagacagggtctcactgtcgcccaggctggagtgcagtggtgcgatctcggctcgctgcaacctttgcttcccaggttcaagtgatcctcctgcctcagcctcacaagtagctggcattacaggcatgtgccactgcgcctgcctaatttttgtatttttagtagagacagggtttcaccatgttggccaggctggtcttgaactcctggcttcaagtgatccacccacctcagcctcgcaaagtgctgggattacaggcatgagccaccgagcctggccaccttaatctttttaagcaaatacagaatggaaactgccctcacaggattaaggagagttacaagccaggctttaggcagcattatatatagttagctgttatccagggtgcacaagtgtactttgacccacttccctgcagctgctaactcactgaacatcactccacgtgctagaccacctcctacctgtttctccatggttcttaccatgagtaagaatttctgacgctagactcataagatcgttttgcccaagaacgggttgtttttcagatcctgaattctgacgtccccaaccaaggaacccactcagcacaagaatgaggtttcttggtctccctgtctcatgacttcgcccttcacttcttgaccaatcatcgatccccacactgcagcccctgtccagaggacttaaaaaccctgccccccaaacctctcagggaggtggatttgaggcttcttcccatctcctcattcagatgccctgtgattattaaactctttctttgctgcagccaggtgtctctgtatgctgactcactgtgcattgagcaaacaaaactattaaattacagtactacttactcttctaattacagtgcttatatgtatgagggttaatataaatacatatgactccttaaaaattaaagtatgttttttctgactataaaaattatacataaccgggtgcagtggctcacacctgtaatcccagcactttgggaggccgaggcgggcagatcatgaggttagatcaagaccatcatggccaacatgctgaaaccccgtctctactaaaaatacaaaaattagctgggcgtggtggtgcattcctgtaatcccagctacttgggaggctgaggcaggagaattgcttgaacccgggaggcggaggttgcagtgagccgagatagagccactgcactgggtgcagagcctgggtgacagagtgagactctgtctcaaacaacaacaacaacaacaaaaaactcatgctagtttaattttcatttatttgatgacttgctatttttccaaatgtttactagtatttttatttcatctattagaaatgatatattcatgtcctactgacttccaagggaaagatagaaagttgttttgccaggaactatgaaggttgtttgaatggagtcatcataacctaaaaaaaaggtgaaataacgaaggtgagatttttacttaccattgtttgttcctacagaaggaatgctggagctgataattatgagaatttatccttccatccctcatagcctaagaatattcattattttcccaatatctgcactgagcctgtaaaccaaaatgtatctgagacatgtctcaatcaatttacaagtttattttgccaaaattaaggatgcttacctgggagacaggcctgtgcctttttccaaaggtgattttgagggatttagtttggtttgtttgtttgtttttgagccagagtctcactctgttgcccagggtggagtgcagtggtacaatcttggctcgctgcaacctccacctcccaggttcaaatgattctcatgcctcagcctcccaagtagctgggattaacaggcgcgtgccaccacttctggctaatttttgtgtttttagtagagacggggtttcaccatgttagctaggttggtctccaactcctgacctcaggtgatccgcccacctcagcctcccaaagtgctgagattacaggtgtgagtcaccgcgcccggccagaaggatttaagattttatttatttatttatttatttatttttatttttgagacagagtcttgctctgtcacccaggctggagtgcggtggcacaacctcggctcactgcaacctccgcctcctgggttcaagccattctcctggctcagccgccccagtagctgggattacaggcgcacaccaccatgcccagctaatttttgttgtttttagtagagacggggtttcaccatgttggccaggctcgtctcgaactcctgaccttatgatccacctacctcggcctcccaaagtgctgggattacaggcgtgagccacggtgcccagcaaggatttaatatttaaaatggaaaagcaggctggaagggaaagaaggagagtatggtcacattactgaattcacatgttgcaagagacaaggagcaagtaggggaatagtcaattatgtattactctcgtgcttaccataagataaggtggacatagagtagttagctgcagtcagtcctgcttaggaatgaaaggaaaggcaacttcttgcatgactcagctttcagcttaaatttttttcttttggcagaatgaattgggttcccaagtttttattttcctttcacaagcctctgaataaacaaagttcctgcccacatggcattcaattgctaaacaattataatcacataaatacatacacatatacgtatatgttttatatatatatatatatataatatatatttaatacatacgtccgggtgcagtggctcacacctgtaatcctagcactttgggaggctgagttgggtagactgcttgagccaaggagttcaagcccagcctggtcaacatggtgagaccccatctctacaaaaaatacaaaatacaaaaattagctggtcatggtggtgtgcacctgtagccccagctactcagaagactgagatgagaggactgcttgagcctggaaggcagaggttgcagtgagccaagatagtgccactgcactccagcctaggagacaaagtgagactctgtctcaaaaaacaaacaaacaaaatacattcatatagagagagaaaaagagggagaattttataatgatatgcatgaggaatgtataggggaagaggctaaaaataggccgaacttactagtgaatatattcaggaggtaggactgtgattgtttttaagtgatcgagggaaaatagtgtactgattttaaaatggaaaactcaacttattttttaaaaattaaaactctgacaagagggaggtttaattgaaatcacagtggctgctcagggaagtttataaatctcgaactgcaacgactcaataagcatgaattgcttgtgatgatattgacttaatagagttattttttccttaatagaaaacacatcttatcaatataatgttatttgtaaagcatggaaaggacaaagtgctcttgggagaagtagaaagagaatttcactctgagaaacctatttggagaaagctcctcatctctggcttagactttaaaattagttaatagtgtaattagggatagttgtagtaatagtggtattggtatggtagttagagtttaaatgtcacacagaatacccagaccaccttcccccaagtgccactaaacttattcttctaatcaaacctctgctcaagggatgtcttcttcctctcttggaaagctgtgttccttacctcagaaacagccctccataaacctgcccttaagagaatccttggccaggcacagtgattcacgcttgtaatcccagcactttgggaggccaaggcgggtggatctcttgaggtcaggagttcgagagctgtctggccatcatggtgaaaccctgtctctaccaaaaaataaacattaaaaataaaaaaattagccaggtatggtggtgcgtgcgtgtaaatctcaactacttgagaggctgaagcaggagaattgcttgaacctgggaggcagaggttgcagtgagctgagatcgttccactgcactccagcctgggcaacagagcaagactccatctcgaaaaaaaaaaaaaaagagagagagagagaatccttaagacatgccttcttggatgccctctggagaaatgtcaagagtagccaatatagtcaccccagtcggctgtggtgtgtgggcctctagtgttttaaggttctaggcaacttagcccctcccaggagatgctgatttacttttctcaaggtgcataaagtctcatcacaccaatatctgaaaaatctcttttcaaagagatgcaggcagccttccagccccatgatgttaatacacagggttaggcagcctggcaagtgcactggggcccccactgaaggatcatctggtttccatagcaacagtccttcctttccacggaggattctatcatctctcctgctcactcaggctttccagaatgaattgttttttgtgactataggtgtttgtccttgatcctgcaaagagaaaagacatattcatttaaaacaaacaccccccaccccgccccgcaactgactgcagctagaatactgcattgcatcagctggtcttcctttcatttaaaaattccatgtcctttctccattttgctccgttctctagctttatccatcattttagaaaacaggtttctctgacagaaaacaaacagatggcaactccatcatcctaaaactggctgtgacggggctctaaaattaagtgttcatggggctcccagaaagcctaggcttgcatggtatgtgtggctgacctgtgagttacgattggaggggcaagagaaggctttctatacacagatggctccccatacagtgtcacagtctctgaagtgttgccttttgaggtttgttttcttaggtcaggcactgctgtcctgtcagtattttcctaaattgccaatactcctgggaagagtaatacgttaggttactaatactgaaagaacttgggaaagagaggagggggtgcagcgggaagggaataaaaggggctctgaagaccacctttgtgtgcttcacagtgacatcttctgcaagaggggaagtgcaggtcttcatctctctctttgtctctctctgtcacacacacacacacacacacacacacactgcaggacgccttctgacaattacaatacagtagtgaattcaccgaacaggactgttccctgaaacacctacatacaatcccgctggaagacctttgaaacagccctgcagtgactaaaaactctgtccccagtgccacttgtttaaccctacagtttccacagactaaaggtagttttcctttggttaatatgaaaacaccaaatagtcagattgctttgttaaataaagtggattacggtgaatctgttcacttctatgttttatattgccctcactccacaaatcacagaagatatttatttttcccccagttaaattctgttaccacaaccattacaaacaaatgtctatataaccaaaatgttagtcagccccattccaatggagcacattttaagtgatgtttaatgggacataatttgaacataaaattctatctgtgcactgttttcaagtctttgaatcaggcctccacctatagatgttggttacctatcagggagcaacaggtgatgctaaggatcactttgtaaaaaccaggaatcacatccctgtaactgacaggaaactgactatattcatcagggttctccagaaaaatagaactaacagaatgtgtatatacataggaggaaattttgtttaaggaattgactcgtgtgatcgtggagactttgggagcccaaaatctgatgggagaagctggcatgcaggaggcccagggaagagttacagttctagtccacaggtaacctgctagagaattccttcttgttctggatgagtttggccttttgtctattcaggctttcaagtgattggatgaggcccacctacattatggagggcaaccttctttactcaaagtctacagatttaaatgtaaatctcatccaaaaacaccctcacagaaacatccagaataatatttgatcaagtatctgggcaacatggccaagccaagttgacacagaattaaccgtcacactggatcacaagggctgtgttcagcaagaactgaccttggtcaaaccctgcccctgcccttatgccccactcttcttcattctgggtcctgctatttccattttatcatgtcttcatcttctttccccacctttcaggtacctttcctctctgaccctatccctagactcacctcctaccccccactcaaagcccttccttccttaaaaaatgatgttagtcattacactttaggatttaaattaatcattctgttagccgtcttactaactttctcactgtgaaaggaaagcatattaaaagaatttcagggatcgacgaagagctgagggaggtatttttctaggaagagaaagtgactaacagaaatcaagacaaagggggacaatcagatttttcagatgacagaaagcaggtaaactctagagatctagagaactagcaaatggtctcttcagggtgtcatcattgcagtaaatgagctctagctatttctgtctttattcttcagggtattcaagattgcagttacttaggagagacagagcatctgactgattgaacttgggttctgtattcactcctgggccagggggaggcagggtacctggtctgacagtccttccaaggctgcatgaaccagaggagctgttaccagaaaagggcagagtgaatttggggcagcaaaaacatttattgcttatcgactatcactgcaaggattactcagagggtgatgcagaatcagcacccctctatttctaagatgaccttgaatgtcagagcaaggcacaaacaggttgcagagacatgtggagtatctggagcactgtctcaggatccttcctctcctgctggatgctaaggaccttaaggacaagagctatctttgcttgcaatttatttggcaggccctgcagggctgtgcaaatgattctatttaatttttactacttgtgagaaggcacagagggctttgagagggcacagagggcctcttataatgggtagatatgcacattagctgatacactggaaactttccagcaggcatatccttccaagatgataaatattcttccttgttggagaaattgaagacatttgtacttgcaatctagcttatctagtaaaacaagacaaactaaccagtgatagggagaaacatgtttgcattattttccaaccttgaaaataatgtcagattattggactgagaaccaatgtcatcttctggatctggtaattatttggacaaaatctctttgattctaggttcaaagtcaaggtgtcaaaaaaaaaaaaaaggatacaactgttaagcttatttaattatacctctcactgtacaaataaggaaactaggccaggcgtggtggctcacttctgtaatcccagcactttgggaggacaaggccagtggatcacctgaggtcaagagttcgagaccagcctggacaacatggcaaaaccctgtctctactaaaaatacaaaaattagctgggtgtggtggcaggcgcctgtaataccagcgacttgggaggctgagacaggagaatagctagaacccgggaggcggaggttgcagtgagccgagatcatgccactgtgctccagcctgggtgacagagtaagactgcgtctcaaaaacaaacaaacaaaaacaaataaggaaactgggctcagagagatgaaggtacacaggtgatgggtagatagggacaaagaaaagaacctaaccctttggactccccaagccattctaatatttgtttttgtaagttagtagcttctgcacgttagtatgtcagaactcaactagtttcctatctttcctgataacctctccgacccacccatgatttagctaacatctgatttggtcaaccaagcaccctggtcctcaggttcagtgtgagacttaatgaaataggcgtgaatttttttttttttttttttttttttagacggagtctcgctctgttgcccagcctcgcaatctcaactcacttcaacctctgcctccggggttcaagcgattctcccacctcagcctcctgagtagctgagatcacaggcgcccgccaccacgcccggctaatttttgtatttttagtagagacggggtttcactatattggccaggccggtctggaactcctgaccttaggtgatccacccaaagtgcttggattacaggcatgagccaccgcgcctggctggcatgaattttttcttctgtccctagttcatcttcaggtcactgtctgattttattagttctcaaatttaaatcactatgcatgctcagctcttctagttatttcccttctttcctcatgttgggaaaaaaaccccgatttattctaattgtgagaaatgaaagcgaacaaatcctatcattccctattgtcttgtgcaaatatgaagagagatatgatagtggggtaaataaaagcatcagggaatccattcggcagaatctttctcctctcagcgtgcttgcagttagatattctgagattccagtggagaaatggtatggtggaaacattgaggttcaacaaggctcaatttagggcatattttattcagattctaccatatatattgtctaaaatgaaacaacactggggaatgaaaaggttggtcgaagatgcaagttgcctttattaaataaagacaaatatttaataaaaataatgtataaaaataatcacaattcactttcaaatctgaaaatactgagttttccaggctacacataaataaaactgccaacgatgacaattccagcaactaggaaaacaagtacgcctacaaagaaaagtgagaaaattcatggagaatttgaactcagaaccaactcctcggagctgatcttttttgggggaagccagggaacgcgccgggcgctctcatcagcaagaccatgtttaaagagagtgtggaagcacagaccaaaatggacattcgagggcgaacagcagctggcaaagggataagtgatccgaagcattaaagcccttgagacaaattccggcgcgaaccgccagtgggggatgagactcgcaggcgcagccctccaggccccggcggactgacacgcacgttggaaacggagtcacccaccacagccccgcagctccagccaaaatggcgccgccgctctgcccaccccgcgcaccccaggcggccgccgagcccgcgcgcgcgccctgtggagcgaggacgccggggacgcggccagggacgcgcgcgtcctcacggcggttgcacgcctgcgcgagggcgggcggcgggggcgcgcgcgcggcgggggcgggctttgccgagcgcagagctgcagccgccgagccggacgtgtccgcgaagatggcgggccgggtgagtgccggtctgggagcccaggcttgaggcaggggcgccgggctcgcgggcactctggggtccaggcggccccagaggagtgggagtgaatccgagcaatggggcgcgaggccagagcgggacttgagggtagcaggggagcggtggcaggggattagccctcctcaacaactccacccccctcgaggggagatgacccctcgttacacgcgtctgctgcgcctcccgtcatcctcccttcccatcccttggggcttgttccctcgtcctccacacagccgcagggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaaggtcgttgggaaagaggagggggtgccaatgacttttagtgttaaagcccggccatctgggggacctgtcaactgtcgggtcaggcaggaattggctttagcttggagtgaggatggatttggggtgtcacgttttgtttttatggatgacactcgcttcgaatgcagcaggatatgctgtagtttcagggttttaaatttacttcctcctttagcctttaggatcgttgggtaggatgggtttggcgaggagagagagctggttgagtgctgtattgcagtctgccttgagctaaaagctctcaagggatgagtcctgcccggagattacactggtcataaacctgaggacattaactgcgtcattgggggtgaaagatgtgattgactgatctatttataacagaatttttgaataagtttgcatagatttatgcatatatgcaaatgccctatctgaagggacttgtaggtcatgagattctagagtaagaagggatcttaaaggtcatttagtttggcttctttctcttccttttccccatggcctctccttttaaggctagtccttctgccagtacttcagaccctatctgtatattcacctgctccttcttaacataatcaagcttctctatcttaaacccttcccccacccccacagctgtcaccttttcccgtcccagtttacagcaggaaatttgatagagttgtctatatttattgtcttccatttgcttaccacctactcacccttcaacctactgcagtctgatttctgccccatcatcccactgaaacctgtccctcaacttaattgatacctttcaatccttatcttatttgatatctcagcagcgtttgacgttgttgaccatggcttccttgacggaaagcactcttcacatgtgttctggaatgcctcgctcctggtttgactcagacctctcttttgcggcctcaccctcctctactttgttattcattgctggtattcctcaaaggccgtcttctcactctcaatttcccgctcaggcaatttcttctaagcccatagctacaactgtctatatgccagtgattctcaatattttacccccagtccagacctgccctttaagtttcaggttaatatgtccaactgcttatttaaaatcaaggtcccgaaacgcagctttttcaactccgaacccaggatcttagcccacctaacttgtgtagatactcctcgacttaacgatggggctaccttccgataaacccattgtaagctgaaagtatcagaagttgaaaatgcatttaatacacccgatctaccgaatatcatagcttagcctagcctgccttccttacacatgcacagaacacttacattagcctacagttgggcaaaatcatctaacataaacctatattataaaatgttgaatacctcatgtcatttattactgtgctgatagtgaaaaacagaatggttgtgtaggtcttcaaagtacagtttctgctgaatgcctatcacctttgcactattgtaaagttgaaaaatgttaagtcaaaccattgtaagtcagggaccatctgtacctatccagtgagataggaatatctcactgaatgataccatcatccacccagttatataggctgggaatctgagggagggagagggtgggtaaccctttatgtctctcttttgctgtacccatgtcctctgccctatcccccggtaaaatttgtcagagttctgctcctgccccccataaaggtatttaattagggccaaagactctggtttgggggaatggttgctttagactagttccaagtcacccactggactatctggattggtcacatgggttctgtcattttaacctaaaaatctccagtctgtccacctttccacatcttcatttttacctccttttcccaaactaccatcatttctggtctggactactgcaggaagcttccaagtatttttttgttcgtttgtttgagatggagtttcgctcttgttacccaggctagagtgcaatggcgtgatccctgctcactgcaacttccgcctcctgggttcaagccattttcctgcctcagcctcctgagtaactgggattacaggcgcccaccaccacacccggctaatttttgtatttctagtagagacggggttttaccatgttggccaggctggtctcgaactcctgacctcaggtcatccacctgccttggcctcccaaagtgctgagattcgtgcccggcctcccaagtagtcttcttagagcatgtggcccacctccaattcattcttgaccttcattgttccttcccgtgcctattactacttaaacccctcctcagcagcatcccattacttttgggagaaaaccaaatccttaatgaggccttcaggactctttgtggttctgctcctgcttctttccactcattctcttactctgtgtgctcaggttatatggtaaacgagcctttcaattccttgaacctgtagtttctcttaccacaaggtctttgcgagtggtgtttcctttctttgtaacgttcttccccccaaccatttacctcctactcagacatcacttagctactcaagggaggcctactctgaccccacattataagtcaggatcctttgttatatactcttgaagaactgtattcctctccttagagatttatctttttgttactttgagtgtgtgttattatttgcttctaccacttcacctcagtgaaaagcagagaacatacaagttatttagtcattatcaactgcgctttgtgtaccttgtgggacttaggtactcaatacatttttgttgaaaatgaatcagtctctgaacactctggtgatagatggtatattaccctaaagcttgcctgtaatgtcatacagctatgttaggtctttgttatctggagttccatgtaacttttatacgtagttactatttctgctgtttcaagccatacggaactaaacacaattctttttccatgtaatagctactcaagctactcatttacttgaatacaggttacatatctcctcagattttcgattttgcaagttaaacatcccccaattcctagcatatttcatattccaaacccttcatcatttaggctaccttcctctggaagtaacctaatgttactgttttgtcaacctttcttctaaaatgtgcccagagtggaacacagtgatcagagaagaatgtacttaagctattattgtcttgagatggacactaccattattcataccagataaaattgtattagcgttttttctatagtaaatcacattcttggctcatactgagcttgtagtcagtgaaaactcatgttcttttaaaatcagctccctagctccattctaggtttagagcagttttattgaacctaaatcaagaccttatccttttacaattcatttttttaggtcagtgcatgtctgctgtttgttgaggtaatctggattcttagttctttcatgttaggaaacataatagctgtctcttccagtttggttagatctgtaggtttaatcatgacttctgtttctacgtttgagttattggtaaaggatagaataagacagggtcagaaataacccttggacatgctgccagtgacatgcctctagactgatacccattaatacacttgggcactgttgcttaaatacagatgtgtctcatttaattccaacaaaacaacctgcaaagtaggtagtattatctttgtttttttgcagagagaaagagagagagatttagtaacttgagaagttcacatagccagcaagaagcagggtcaagatttgaactcagatcagcctggtactgttacctagttcaccagcttagttgcaagagtgtagtaaagactaggtttacctcacctagaactttttggacataataatgttcagaaactatcttctaccttttggaaaatctgaaaaactttggcccatctgattgtctatcatttcttctgatagcctttattttctagtaactactgagtgatttttagcaaaaatagttcaccttgttgcaatacttttatttgtgcatatttatggagtacatgaaaatttttttacatgtgtataatgtgtagtgatcaagtcagggtacatgagtccaatgtattaagtatagtcatctactcagctatcaaacattgaatttattcctcctatcactggatcttttttttttttttttgagacggagtcttgctccgtcacccaggctggagtgcagtggtgttatcttggcctcactgcaacctctgcctcccgggttcaagcgattctcccgcctcagcctcctgagtagctaggattacaggcatgtgccaccacgcccagctaatttttgtatttttagtagagacagggttttaccacattggtcaggatggtcttggactcctgacctggtgatccacccgccttggcctcccaaagtgctgagattacaagtatgagccaccgcgactgacctcattggatctttttaccttttaacccacttctcttcagcctttctctcccttactccgccttcccagtctctgttatctatttttccactccctgcctccttgtgttcaaattttgtagctcctacatatatgtgaaagcatgcaatatttgtctttttgtgcctggcttatttcacttaagagaataacctccagttccatccacattgctgcaaatgatatgatttcattctttttatggctgaatagtattccattgtgtacatgtatgacatcttctttatccattcatctgtagatggacacttaggtggttgattccatatttttgctattgtgatagtactgcaataaacatgcaagtgcagctatccctttgatacattgatttcttttcctttgtgtagatacccagtagtgggattgctggatggaaggtaattctatttttagctttgagaaatctccatacagtgttccttagtggttgtactagtttacattcccaccgacagtgtatgtgagagttcccttttctctgcatccttactaacatctgttactttttgtctttttaataatagccattctgactggggtaagatgatatctcattgtggttttgatgtgcatttctctgatagtggtgtggaacatttttccatgtcttcttttggccattgtatgtcttcttttttaatgggattatttgttattttccttttgagttgttcgagttccttgtatgttctggatatcagtcctctgcttgatgaatactttgcaaatattttctcccattcaacaggttgtctcttcattctgttgattattcttttgctgtgcagaagctttttagtttgcttaagtcccatttgtttagttttctttatgttacctgggcttttgatgtcttaatcataaattctttgcttacaccaatgtccaggagtgttttccctagactttcttgtagtatttttatagttttgggtcttaaaatcttcaatccattttgagttgatttttgtatatggtgagagataggggtctagtttcacacttctgcatgaagttatgcaattttcccagcatcatttattgaagacagtgtcctttccttagtgtgagttcttgtcagtgttgttgaagatcatttgtctataattatgtggttttatttctggattctctattctgttccattggtctacatgtctatttttataccaataccatgctgttttggttactatagctttataatatattttgaagtcagataatgtgatgtctgcagctttgttctttttgcccaggtttggtttggttgtttgggcttttttctttttccttttttggtcccatatgaatcacattggtattttgatagggatttcattgaatctgtagattgctttggcaatatggtcattttagtgatattaattctttccacaagcataggatgttttttgatttattttctttcattggtgttttgtagttttctttgtagagatctttcacctccttagttaaatgtattcctaggtttttgtttgttttcggtagctattgtaaatgggattgccttcttaatttctttcttggctagatccttattgatgtatagaaatgctactgatttaaaggttttctaaacctacagatatataatcagcaaagagacaatttgactttctcttgtccagtttggatgcctttcatttctttctcttgtctgattgttctggctaggatttccagtactgtggtgaataggagtggtgaaaatgggcatccctgcctcattccagcttttagaagaaagatctcacctctcctcattcagtatgatgttagctctgggtttgttgtgtatagactttattattttgagatatattccttctatgcctaatttgttgagagtttttttaatcatgaagggatgttgaattttatcaaatgtttttgttgttgttgcaatactcttttttttttttttttttttttttttttgagacagagtcttgttctgttgcccaggctgtagtgcagtggcgcgatcttggctcactgcaacctccactcactgggttcaagcaattctcctgcctcagcatccctagtagctgggattacaggcctgtgctaccacacccagctaatttttctatttttagtagagacagggttttgctatgttggccaggctggtctcgaactcctgacctcaagtgatttgcctgccttggcctaccaaagtgctgggattacaggcgtgaggcactgagcccggctgttgcgatactcttaatgggttttatatttcctttttgtgggggacagtttattttgcattcttactacttttgatattctgacatcatcttataagtgggatttatattcactatgtaattgaagttttttccaatgaagcaccgtatatagtttatctgggaaattggctgaagaataaaatgtgtgatgttattcagtgtacagtttctaggtcatcagaagataccactaccttcccactactggaaaagaaaaaagaaaagttttccacagtgcctgaactgttttgtatgcttatcttttaaaattgccagaaatctcacttactggagattcagcagtccctttctgaaaatacacatactttagtgcaaataaagccagtggatctctttcttcataagtccttaaacctagtcgaggtcatctgtttggcagagataggagtaagataatgtgaaataggaaccaacgagagagaacttgcttaggagttgaaaggggtatggaaagatgttagaggtaaaatttgtcgaatctagtgttttgactagggcaggccagaatattcagtatcagtatcaatatcagaagcttttgtagcctttgtttagaaacctagtcatttataacattttgtgggtgaatgacatcattaccaaacaaactttcagatgaaactttggaactcaagctgtaaattgtggatagctcatgtgcagtactacaaatcaaaacaaatactataaagtgtttggtagtccatttcctgaatgaaagtttgtccaaagtatatcaactttctgcagtcttacatgcagtagttattagttttgtgtatcgctttagtggatatttttaaaagtatcttcaaatgcaatgaattttaggaaacaaaacaattctttaaagcatcattagatagcttcttctttctgaaacccagaggaatttatgtataggatgactctttttttcaagtagttaagttaaggtgcaaaagtataaggtaaagtatattatcttaccattgaaaattttggcagtggcagaagagcgaacccttacaaataccttcattgggcaatacactaagcacttgctgtaatgctttttaaaacatctatactctggctgtggtattttaagtgaaaatctctcagtgagatactctttcgtattttagtactgatatccttaatattgctctgagagctaccttatactgacttcagtttcctagtgatttaaactactaatttccaacttatttttttttatagtgaaaactaaatattccttttgtagatgtaaccatttctggaagccctaagtatttttgaatgagtataattcatgcacactttaagagatttcaagcatgacaagcacagtgaataacatatatccatgtgattaccactgaggtttaagaaatgttaacatatgatatctgcttcagatatttatctttttaaaaatagaacattacagctgggcatggtggctcacacttgtaatcccagcactttgggaggctgaggctggtggatcacctgaggtcgggagttcgagaccagcctggctgacatggagaaaccccgtctctactaaaaatacaaaattagccgggcatggtggcacatgcctgtaatcccagctactcgagaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctcctttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgtgtgtctttaaaatgtatataatggttttatgctatatctttctttctgcaacctgcatttttcacttaaaataattttgaaatttagtcctgtggatatatagtgagccaattaattctgcttagctactctgtagtctgttttgtgaatataccacaatcatctactttcttattagaggacaatttaggcagttccaattttatttttcccggaatgtacattattttagtcgagtgccattgccacattagcgatattttggttagtgagggactgcagataggaaggtgatcccaaaagattataatgccatatatttactctacctttctatatttacatatgtttagttacacaattacccattatgttacagttgcttacagcatttggtgctgtaacatgctgtacaggtttgtagcctaggagcaataggctataccatataggtttgtgtaagtacgctctatgatattcatataacgatgaaatcacctagtgacacatttctcagaatgtatccctattgttaagcaacacatgagtgtgtgtctccatgcatatatgtgtaagagttagcatgtgtgtccagaggtagaattgctgggcgataagtcatactcatctttacctagttatgccagtttatactgtcactagcagtatatgagtacctgttatttatatcctctccaacacttaatattgctgacattttaacttttacaatataataggtgtaaaactattgtttaaatttgcatgttgtcctcattactagtgagattaagcatttttcatattggtcattgggatttccccttctgtgaattacttttgtatatttgctcattttttctgttgggctgtgtatttttttagtgatttgtataatttttcgttttttggggggtagggtatgctttggattctaatcctttgttgtaaatagcttctctcagacagtgatggtcttttcatgatgtttatagagtgttggatttaaattttatagttataattaccctttttttttttttaccttggtgatttgtgcttttatgtgtttttcaggaaatctttctccaccctgaagtcattttcttataaaagttttaaaattttgccttgcacattttggtgattgatcaggaatttatttttgtgtttggtgtgaattatgaactaattttatcttttccatatgtataaccagttgtctcaatatcatttattgagtccatttttttcctttactgatttgcaatgctatctctgtattatatccagttcccatatatgtgtgggtctaagtgtcgactctattccgtttcataattctttttgtccatatttgcatcaataacactgttttaattgctgtagctttaaaattattcttgttatttcatagggcgtactttcattacctttcttaatttggcatttcttggctcttttccgtatgaattctgggaacaacttaatccccactcctttaaaaaaaaaaaaaaagacactttggcctggcatggtggctcacacctgtaatcctagcactttgggaggctgaggcgggtggatcacttgaagccaggagttcaaggccagcctggacaacatggcaaaaccctgtctctaccaaaaattagcgggcatggtggcacacgcctgtaattccagctacttgggaggctgaggcatgagaatcagcttgaacccaagaggtggaggttgcagtgagttgagatcgtgccactgcactccagcctgggcaacagaacgagacagttttttgtttgtttgttttaaagacacttttaaccttccgctatggatttttgacctacatttttcctcttgtattttataagagtagacacagagagcacttcaataaaattcagctcaataactttattaacctgatctccttttctttgactttaagctgaaagtgttaatttctcacaacttgtgctctatagatttgaaaccaaatcaattagcatcagctgtttatgagtaatgcagggtattttggtcttttgctaaattcagaaagaaatgttaaagtgctgatggatttgcactagctgtatagatctttggtggaggaggaaatgggaaaattattaatttcaggtaagaagtcatttttgaaatgcaagattcatttctttttaaaatcaccacataataaaaactttaagggctgcattggtgggtttttaaaaaaaattgtgaagtgtttttagtgttatgtgctgacaaatatttttgtagttgctttgacaagcaatgaaactaccaattatcactaattctgagtcttccaatgaacctctgtgtcaaatttttaaatttaattatcctgactatttttctcctagagaataatattgatataattttgtgaaccatagcagacagttcccattgctgagaatagagcctggtgtggggatattatgattcttgaatggttgaacaagacatttgcttctgaacatcttagtaaattatcacttctgacaatgtctgtagtttgaattttgatattctctgccaaggtattgaatactctaaataatgttgtttattctattatttaaatcattagtattatagatctagctttaaacagctgctgcactccagtcctttttcttcacctgcagatattgagtctgataactgttttgtatacatagcctttcagtaaatctacttatcagtcatcaaattaacttaattataagttaaatgatgagatggaccaagagtgttattgaaatctcatttccacacatttcttctcttcttttgtagaaggtaatgaaatgaacctgtcagtgttcctgtttttatgaagtttatttctcttagtacagtgattctgatagtgggttctgcagaccagcaaattagcattatctgagaacttgttagaaaagcaaattctcagttcccacttcaggctgactaatttagaaaccctggggtagggcttagcattctctttcaataaattctccaggtgattctgatgtatgttaaagttgagaagcattcacttagtgttttgagctctccaatttagttccttataaattgttgaagatattttttccagatttctttccaaatatgtgctcaaccttgttactgataggtttcaaggttatcgtcttcttcccattaataccttcatctatatccaattttcaaacttttaagaaagcatggctattttgctgcagtatggtgaattaggtactctgactgaccttcccagataaacaatttaaaattctagataatttttttttggagggaggacagggtcttgctctgtcacacaggccggagtgcagtagtgtgaacatggctgactgcagcctcgacctgttgggctcaagcgatcctcccacctcaacctcccgagtagctggggccacaggtgcacaccaccatgtccagcaaatttttttattttttgtgcagatggggtcttgccttgttgcacagactggtctcgaactcctgggctcaagcagtttttccacctgggcctctcgaagtgctgggattacaggtgtgagtgactgtgcctggcagatgaaatattttttaagtaaaaaccttatgtgcatggagatagctggctgaaaagtaaggaataatcaggccaaaaactatgtgaaggtgaaaacccagagatataagccaagtactgctgccttgaggacattatttgcaaatgacattacttggaaaacctagttaacttgtgcttgtgcctcaagaagctcagagaacggaagataaaagtagttttctggtagaacgtcccacctctcctggtaaagatggtaccccaagggtctatacatcataataaatgagaactagtaataaacgtaccttgtctaaggatcggaaagaaaaatttcctgcctcaaactttggtggtgatgggaagggtacagaaattccctgagaagttttacccacaagctgaccttcatgcaggtttgaatcctgattttatattacctggatggtatgaaaatcttaagccagtaattaaatataaaagtggtacaagagtgacgatgccttaaaatgcctaagaatgcctaaaaagcagcaaatacaaagcttcttgggagaacccatcttgatcttaggatttagaaaattcctaaacataaagctgtaagaaatatgaactcacattcacaaaatgcagaaagaaataagatgcaatgaatgagaggaagcagaaacaataaagagcagaatcagaacctgcaaagagttcacatattggagttagcagacacagattataagtacatatatttaatatgcttatagaaaaaaagaaatttaaaataggaatgaggagcaagtatacaaaaatgaccagtgtacaaatttaataacagattagacacagctaaagaaagatttagtaaagtggatctgaaaaaattgcagtatagaggcaagaaaatgaaaagtaataaaagagttaagagaatacagagggtagaataagaaggttcagtctagtcagaattctggggcaggggagcaggggcatggaaaagaatgaggcagaggcagtatttgaagagataatgacagagaactgatgaaaaacaacctacaaatttaggaagctaaagaatcccagaaaggataaaaagaaaaaaaattcacacataaacattttttaaagaaactacatgataccatagagaggtcttaaaagctgtcagaggctgggcatggtggctcacgcctgtaatcccagcactttgggagcccgaggagggtggatcacctgaggtcaggagttcaagaccagcctcaacgtggagaaaccctgtctctactgaaaatacaaaattagccgggcgtggtggtgcatgcctgtaatcccagctactcaggaggctgaggcaggagaattgcttgaacctgggaggtggaggttgcagtgagccgagatcgtgccattgcatgccagcctgggcaacaagagcaaaactccatctcaaaaaaaaaaaaaaagctgtcagagaaaaaagatattaccttcaacaagtatttggctgtcagctgttttcctgtctataataatgaaagccataagacagggagtaatattttccatatgcttagagaaaataattgtcaaccaagaattgtatatcttgtgaagaatgggggcaaaattagacactttaaaacagacaaacactcaatgttgtaaccatcaaaccttccctactagtggaaattcagatcaatttcctgaaggctaaaaaaaaaaaaaaaaagtgaccactgatgtaaagtctgagatttaagaaggattgaagagtaaagaataatggtaaatctgtggatatattgaaataaatattggctttataaaatgatgtatgcggaggttttaaaaatagaactaaataggccaggtgtggtggctcacgcctgtaatcccagcactttgggaggctgaggtgggcggatcacctgaggttatgagttggagatcagcctgaccaacatggagaaacctcgtctctactaaaaatacaaaaaaaaaaaaaaaaaaaaaaaaaaaaaaaaaattagccgggtgtggtggcgcatgcctgtaatcccagctactcaggaggctgaggtaggagaattgcttgaacctgggaggcagaggttgcagtgagccgaaatcacgccattgcactccagcctgggcaacaagagcaaaactccgtctcaaaaaaaaaaaaaagaactaaatatatgataacaacatccaaatcaaaagagtggttaaagtattttatgatctttatactgttgaagagaaaggtaaagctattcaattaactttagattttgataggtatgtgtattagtattttcagagtaactactaaaataatataaatattaggaataatttatagcagaaaaaacaatttttaaaaggcaaggaagaagtgaaaaacatagaaaaggtcagataaagaggaaacaataaaatatagaaatcaaatcaaatatatggtagactaaatgcttcattcagacaaagaatgtcagattggattatttaaaagcaagcaggccgggtgcagtggctcacgcctgtaatccgagcactttgagaggctgagacgggtggatcacttgagatcaggagttcgagaccaccctggccaacacggccagctggccatggccagctaatacaaaaattagctgggtgtggtggtgcacacctgtaatcccaggtacttgggaaggtgaggcaggagaatcacttgaacccaggaggcggagattgccgtaagccaagatcatgccaccgtactccagcctgggcaacagggtgagactctgtttcaaaaataaataaataaataaataaataaaagcaagcaaacaaacttactgaaacaacacaaaatccagctataattttcaagagagatagctaatacatatgaatgtagaaagatagaaagcaaaaggatggaaaaagtctatcaggcaaactctaaccaaaagggaggtaaactaactatattagcatcagacaatatgatctttcagacaaaagagacagctagagataggtccctcaacaatgagaaaaggtttatttatccataaaggtaaaaacaattccaaacttgtgtgaacctaataattgcctcaatatacaaagaacaaaatgacacaattataagatgaaatagacaaatctaccatggtgaggagtttcaaaactccctaattgaaaaattaaaaagacaaaatggttacagctgaaaattaaaattaaaaattcattttctcggttgcaatagccatttttcaagggcttactagtgacatgtgacaatggctgctgtattggacagcacagaaagtacttttgcactgcattaatttagaagacttaatataattaacaatattaataattgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaaaaaagtgattaattggatttcatcaaaagacactgacttagtttgcttaggctgccataacacaatactatagacttggtggcttaaacaaaataaatgtattttctcacggttctggaagctggaagtttgggaccggggtgccagtatgactgcgttttggtgagcactgtcttcgtgacttgcacacaggcttcttgccacgtgtctgtgtggcggagagacagcaagatctcaccatctctcttccttttcttataaggccacagtcttgtcagattagggcccttcgcttatgacctaatttagcctcaattatctcccaaagtccctatctccaaaatagttggggtgggggaagtgccttgactaatgaattttgttgggggcagtggggagtgcacatttcactccatagtagacaccattgaggagaaagaccagagtggaagaaggtatttgaaatacatgtatttgacagccaggcacggtggcccacacctgtaatcccagcactttgggaggccgagctgggcggatcacgaggtcaggagatcgagaccatcctggctaacacagtgaaaccccgtctctactaaaaatacaaaaaattagccaggcgtggtggcgggtgcctgtagtcctagctacttgggaggctgaggcaggagaatggtgtgaacccaggaggcggagcttgcagtgagccgagattgcgtcactgcactccagcctgggcgacagagcaagactctgtctcaaaaaaagaaaagaaaaaaagaaatacatgtatttgacaaggacttgtacctggaatatataaagaactacaaatcaagaataaaaagaaaggacagaaagccaatggaaaaatgaacaaaggattcaaacagggatttcacaaagaacttacctgtaacgtatgttaaatgctcaacctcattagtcatcagagaaatacaagttaaaacctcagggagatattactacacacccaccagaaagttaaattaagaacacatttgtcatgacaattctgggtttgattttgttttgttttttgagatggagtcttgctcttgtcgcccaggctggagtgcagtggcataatcccagcttgttgcaacctctgcctcctgggttcaagtgattctcctgcctcatcctcccgagtagctgggattatgggcacccaccaccacgcctggctaatttttgtattttagtagagatggggttttgccatgttggccaggctagtcttgaactcctgatctcaagcgatccacctgccttggcctcccaaagtgctgggattacaggcatgagcccgcgcacctggcctgtcatgacaattctaagtggtgatgaggatgtgcagcagctggaactgatgaaaatgcatgagcacaacctctttggaaaactagcagaattccctaaaactgaatgtaggcatgatgcccatgacccagcacttatagtcctgggggtgggaggagtgaatatatttctattcatgatttctatctctgatgacagaaattaagctagtgggtatctgtggttgagtagaaggatagtgactaggagcgggcagtatgggatgctggtaatgtcctcttgacctaactgttggttaccctgggtgtgttcacttgtagaaattcattgagccaaacacgtacaatgtatgcatttttgtgtatatatgttcttcttcaataaaaacttgatttaaataatgttctttttcttaaactgggtagtaggtttatggtgttttatgtgttgcctgtgttttatacatattttattcctgttcagtgtccaaaaaatataaaaagtagtcactgctttgttgttaatttgagcatctcctgcacctagcacagtgcctgggacattatagatatttattaaatatttgttctatggaaaagaagtaggctagtaatttctttttgctttccaacagccagtttttgattcaattatttgtaaatatgatttctactcagttgtttctaaataataaaatatgtaaatactattatgtttatatttattagtaagctgaatttattaaatgagaaacctctcaatattaaggacacatcataaattattagcatgctgtgttataatgactaaaagtagtatcaacaatttagataagtatagtgtggccttacggatgtaagtccgtaagatcatgcagcattgaagatgtgcagtttactagatcttctaatattctcgggtgtctcactgtttcttttttttttttttttgagatagggtatcactttgtcacccagtctggaatgcagtggcgtgatcagggctccctgtagccttgacctcctgggctcaaacctctcacctcagccccctgaataacggggattactgatttgtgccaccaagccaggctaatttattttctttctttctctctttctttctttctttctttctctctctctctctctttctttctttctttctttctttcctttctttccttctttctttcttttctctctttctctctctctctctctctctctctcttcctttcttcctttctttttgtagagtttgggtctcactatattgcccaggctggtcttgaactcctggcctcaaatgattctccctccttggcctcccaaagtgttgagattatagttttcagccaccgcacccagcctcactgttttcttcagttgtttctgaacaactggaatctcagctgtctttttccattaaatcccgtgttcgttcctccataccatgctgcctcttgcccatttttgcatttctcctttctgctttcctgaacatcctgagtcttactgggctggcattcccttgttgggacaggggagaggctctaggccttggatccttgttctgattccttctccaaagagttttccctttttcttcccctttcaaaacaacataagtgcaaaagctttgtcaggatgttgggaattaaaaaagcttcagaaacattttgattcatttaacaacattactctgaaactttttagagtaagagtaccaagtcactgaataagacgatcttgaaattaaacgatattttacagttttaaaaacaccttcacagatcttttcttattagattctcagcacaaccttatgagttggcactgtcaaaattcagttcaacaaacaaaatccaactaacaggaaaactcacagctaacatcatacttaatggttgaagactgaaagctttcccccttaagatcagaacaagacaaggatgctcttgccactcctattcaacactctattggtggttctaggtggggcagttaagcaggaaaaagaaaagacatttatatcagaaagaaataaaactatatttaccgatgacatgatcttacatgtagaaaaatcctacagaatttaccaaaaaaaattggaactaataaatgagttcagcaaagttgcaggatacaagattattatctaaaaatcagttgcattcctatatgctagctatggataatctgaaaatgaaatagaaaaaattccatttataataacatcagaaagaataaaatacttatgaataaagttaaccaaagaagtacactaaaaagtacactaaaaaacagaaaacatgttgaaggaaattagagatctaaataaattgaaagacgtcctgtgttcatggcttggaagacttaatattgttaagatgacagtgctacccagatttatctacaggtttaatgcaatcactatcacagttcaactgcctttttcccggaaatggacaacctgatcttataattcatatggaattgcagagccatatttgccacaacagtcttgaaaaaaagagaacaaaattgtaggactcatacttcctgatttcaaaacttattacaaaactacagtaatccagatggcatgtcactggcatgaggagagtcttgtaaaccaatggaatgcaatttagagtccagaaataaacccatacatttatggtcagttgattttgaccagggcgccaagatcattaactggggaaagaataatcttttcaacaaatgttgctggggcaactggatatctacatgtaaaaaaataaatttggatccctgcctcacatcacatatgaaaattaactcagaatggatcaaagacctaaacctgttaagttcttcgaaggaaacataggtgaaaatctgtatgaccttggattaaatggtgatttttaaagatataacacaaaaacacaagcagtgaaagaaaaaggtagataaactggactttgttaaagttaaaaactttcatgcatcaaaggacactgtagaatgaagacaactcacagaatgggggaaaatatttgcaaattatatctctgataagtatatatattttatatatatgttgtttatatccagaatatgcaaagaaccctttcaactcaacaaagataagacaatggaatttaaaaatgggcaaagcatttgaatagaatagacatttctccaaagaagatgtacaaatgacctataagcacatgacaagatcttcaacatcatagtccatagggaattacaaatcaaaaccacaatgagagataacactttacaccctctaggatggtcatactttttttttttttttttttaaagacagtaacaagttttgataaggaagtagagaaattggagccctcattgctgatgggaatgtaaaatgatgcagctactgcacaaaagttttgcagttccttaaaaaactaaacatagaataactcagcaattctactcctgggtatagacccaagataattgaaaacatatgttcatacattaacttgtacatacattaacatgtggcattattcatagttgccaaaaagtggaagcaacccaaatgtccatcagctgatgaaatgataaatacaatgtggtatatccatacaatgaaatcttatccagctgtaaaaaggaatgaagaagccaggtgcagtagctcacaactgtaatcccattgctttaggaggccacgatgggaggattgcttaaggccaggagttcaagattggcctgggcaacatagacccagtctctacaaaataaataaataaaaagaatgaaatactattacgtgccacaacatgaaccttggaaacattatgctaggtgaaaatccagtcaccaagatgacgaattgtatgattctgcttacgtgaaatgtccacaataagcaaattcatagagacagaaagtagattagtggttgagaaggagtgagagaagggatgaattgagattaacggctagtagggacagagtttctttttggggtgatgggactgttctggaattagatagtgattatggttgtacaacatagtaaatatactaaaaaccactcaaaggctgggtgcagtggctcatgcctataaccccaacactttgggagactgaggcgggaagattacttgaggccaagaggtcaagaccagcctgggcaacacagcaagaccttgtttctacaaaaaaaaaaaaaaattgttttaattacctgggtatggtggtgtgtgcctgtagtcccagctactttggaggctgaggtgggaagatcacttgagcctgtgaatttgaggttacagtgagctgtgattgtgccactgtgatccagcctgagtgatagagcatgaccctgtctctcaaaacaaaaccctccaaaaaacaaaaaccacccaagtatacattttaaatgattaattttatgtgaaatatatcagctgggcgtggtggttcacacctgtaatcccagcattttgggaggcagaggtgggcggatcacgaggtcaggagatggagaccatcctggctaacatggtgaaaccccgtctctactaaaaatacaaaaaattagccaggcatggtggcacatgcctgtagtcccaactactcaggaggctgaggcaggagaattgcttgaacccgggaggcagaggttaaagcaagccgagatcatgccactgcactccagcctgggcgacagaacgagactctgtctttaaaaaaaaaaaaaaaaaaatctcaaaaacggcaatgagaactcaattaatatttatcatactgtatattccctgagtggtgcaggagaatcagagcttagaatcttgtgaggaaggcatggtacttaaataagtctagtgtaaggcagcttgtaataagtagtactaagactgctgaagaagcacaaataaaggagatattctatcttactaggaaccagggagtttcacaaacttggctttgcaaggtgggaaagattttcacaggtggaaggggtttgaaatagggaattcagtcaaaaggaatagtgtgagtgaaggaatggagtttggaatgtggggtacatggggttggggtggggtattgaggtagatgacgcagaaaaataagttaaagatagatcttgcataggtggctgtgagtagcatgctaaggagtttgggctttattacttatgaatcatatttttggtttcaggtcatgtctggtggcagagggaaggctgaattggaggagaacaaaagctagaaccagggacaacaattattaccattgtagttttttaggagaggtgatatggctgaactaggttatggttgtgaggctggaagggaggcacatccaagtgacagtgcagtagacttagtagactcttgattgtttatgtgtgcattccagggataggcagtgaagggaagaatgaccctgaaatcttgaatttaatgacttgaaaggataatgatggtattaacagatgaggaacatagcaagacaaacaaatgaaaaagtgaatactgaggagaaggaggtaccactgaatttggcatttagtcattggtgattttgaagacagcagttacagtaaagtggctgctggaaaggatttcaaagaatggttgaagaagatagccataggatgagaacatggaaggcaaggaagggagacttgagagatttggtaataaagagaagagagaaaagggtgctagtttgaaatgagttaaaagaactacagagtagaattaaaataaagtagaattatgggatttttgctttttaagtgacccatgagaggcttactggcagtgtgccaagattcaagagagcaaagattggcagggtgggattaagtgatgggatagccgggtgcagtggctcatgcctgtaatcccagcactttgggaggctgaggtgggtggatcacttgaggtcaggaattcgagatcagcctggccaacatggtgaaacctgtctctacaaaaaatacaaaaattagccgggtgtggtggtggttgcctgtaatcccagctatttgggaggctgaggcaggagaattgtttgaacctgggaggtggaggttgcagtgagccaagatcgagccactgcactaactccagcatgggtgacagagtgagactccatctcaaaaaagagaaaacaaaaaacaaaaaaaaacgacggtagggagccttctgcctctttaaacatttgagatgcatgtcctgagatgcttctgtgaagttaagaatattaattttttgatacgaatctgacaaaactagacatcaaaatatgccatatatggtaattaaaacaatgtggtattagtatagaaagcagacaaatagttaatgaagtagaacaaccaacccagaaatagaaccagatacacctgaaaacttcatatatgaggtttaaaatcagtgtggaaagctggaaatcacccatagtttcgttatccagtcagttgtttttcacattttggtgtgtttccatttagttggtttgccatacttttttaaaaataatgctttaaggctgagcgtggtggctcacacttgtagtctgaagcaggcagatcacttgaggtcaggagttcgagaccagcctggccaatctgatgaaaccccatctctacaaaaaatacaaaaattagcctggtgtggtggtgcttgcctgtagcctcagctacttgggagactgaggtgggaagatggcttgagccagggaagcaaaggttgcagtgtgctgagatggcgccactgcactccagcctgggtgataaagccagaccttgcctcacaaaaaaaaaaaaaatgctgtaaagtaaaagttctgtatacaattctgtgatatgaaccctaccttagtgtgttatgaggattttgatccttatatgatatgatatatataatcaagtgcgggtacgttgtagtttacagaaccattactttgaaacaagacctttaggttactcctaattcatcactgttaaaataatgctgtagggaaaaaattacacataaaagttttctatatttaaagtgatttttgtgagacaaagtttatttattgtaaaaacagttccagcagttcagaattgtaaagagttttacagaattgtaaagagttcagaattgtaaagacattttcttgtctttctccttggtggtaaccactgttaacagtttagtgtgtatcttttttttaagtttagtttttatttttttgtagagacagggtcttgctttgttgcccaggctggggtgcagtggtgtgatcatagctcactgcagcctcatactcctgggctcaagcagtcctcccacctcagcctcccaagtagttgggactaccggcatgtaccaccacgcctggctaatttctgtatcttttgtagagacagggtttcaccatgttgcccaggctggtctggaactcctgggctcaggcgatccccctgcctcggcctcccaaagtgttgggattacaggcatgagccactgcacctggactagtttctttttaatttctgagtagtagtcaattgtatggctctcctataatttcttcattcattcatcttttggtagacattcatgttgtttccatttttaggctattatgagtacagctgttgtgatcatttgtgtgcgagtctttgtgtggatatattttcatttcttttgactaaaaacctaggggtgcacttgttgggtcacattaactttgtagaaactgcattgcatctttgccgatattgaaagttgtcagccttttatatttttctgtgcatgcttttccccccaaaagaccaaaatgggaattgtttttcttttcattataaacttgtaaaggaattttaaagttctaagggatgccaggcaggaggttcatctatgtgaacagttattagtttgagatagataatgtcaaggatatccctaaaggcttttcaagagataactataggacatataagtttaacttatttctaccccatcacttctagtcacatgtgacttcagaattttaacagaaattattattataggaatatgtagcacagagggattccataggcctgaagattagtactgatggcctttcttgcattattctaggctagtgctatccgatgaaactttctgcagtgataaccactagccacaggtggcttttgaaacgtagggctagttcaactgaagaattgaatttaactttaaattaatttgaatagtgaaatatgtctagtgattaccgaacagtgtagttctgaaatgttatttttcaggaaagatcctctagcaagaagtagttgagtgagacctgttagctgagctggccctggggcaggtttgtgttttcagtccttccctttcctgtgggagaaatgaaaccaaagcctagagcaccacagaagaagaaccagtggattcataagggtgacagttcaggtaggggaagctgtttggtaatgagctcttttggtcagatgccacactatttttctttctgtttattttgccctattaaattatttagtaaatagtaaagcgtactttaatccagtttttaaagtggacgtttggatgaaagtatgtgatttaaattccaaaactgtgcagtgttgtccagaagagtcctgattaaatcaccccagtttctttgatgaagataagcaaataattttattttttgctgtaatcccagctactcggaaggctgaggcaggagaatcgcttgtaccagtccggaggctgctgccctctcacagggcttcctcctcttgcacagacgcaccagtgccttcagccccactggtctccctcttctcctttcctggcccctgctggcccagtagatgggccactggaggccactagatgggggctggggaatgtgatgttggcgatctgcggtatcttcagggtgacagccatacccaacgcgtgggacctggcttccacatctatagacctgacctaaggaaatatgtgggcgtgtgcataaggatgccatctcagaactgcatattaataaaaagctgaatcaaacagtgtccaacaagggtggctgttccagctggtcatctacaatctcagctcactgcaacctccgcctcctgggttcaagcaattctgccttagcctcccgagtagctgggactacaggcacacaccgccacacccggctaattttttgtattttagtagagatggggtttcaccatgttgcccatgctggtcttgaactcctgagctcaggcagtcctcccaccttggcctcccaaagtgctgagattataggcgtgagccaccgcacctagcctgtactttcatttcttaataactgcatgactgtagtggttggctttcattattgtttcctaggggcaaggtcaatgttagaaaaattgtggaattttcccttggcattgctgtggtgagtagacagctactatttatagagacttatacttcgttgaaaaaatgagataccatgcctggcttaccataaaaacacagatgtttctggattccagtagggaggccttttgttcacagcatctgttttggttggccagccagatgacttctgtggattttttcactccttttgaaggacacttgacaaataaacaagtttataaatgaaagagttaacagcattttgtaaatttattttattactttagctatatcgttctgtatattttgaactatcagatcattttagctcaattttatcacttcctaaataaccttgagacgatcagtcctttgttacatgttctttggattgtttattctgcagttgagacagatttttattgatctataaatttttgtgttcaacaaacatttaatgagtattcactgtgtactaggccctgtactaacactgggaactacatatgtgagcaagatatagtctcagtctttgagaagtttagtgtcttatatgcagtgcaaacatgtagacagaataaaattatagttgagtccttccatttgaagtttatttcatcagtttagtggggaggggtaggtgtctaggaatgccttccagaaaaagtagtgtctaagtggagaattgtagaatgagtgggagttgtccagggatggaacaggggttagtggcggagattatataaaagaaagaagcttgcaggtgaaaatgaccctgggaaagtgggaaactgaaaaagttcagtacatttctgtcatatggctgatcaagctgtgactgggcaaaatgctgtcagcatttgttgaacacataaatgctgtctcattcacaaaggagacttgtgacctagactttattcatcttgtgctaaattagtgatttccaaacatttgatcatgaatctcataagtaaaaaatgttttgattatgtatcctcatatattgattatatgccaatatttgtttatagatgatatgtagtactaaaagttatatacgcagtagaacatgtatagaaaacaaaaaaaattaaaaggatgagctaaagatggcatgtacaatattctcacagtgttaattttactgaaaatacggaaagtaggctgggtgcagtggctcacgcctgtaatcccagcactttgggaggctgagggaggcagatcacttgaggtcaggagtttgagacaagcctgaccaatatagcgaaatcccatctctactaaaaaatacaaaaattagctgggcatggtggcacacgcccgtaatcccagctactcgggagggtaaggcaggagaattgcttgaacccgggaggcggaggttacaatgagccgagatcatgccactgtactccatcctgggcgacagagcaagactccatctaaaaaaaaaaaaaaaaaaaaaaaaaacccagaaagtaaagtggtacatcattatttaaaatcttcgtttaatattatgtgatacagctgctcagagggctgtttctaaattcagtttattttgatactttaatggcagtcaaagcctggatcaaaatggaagaatttggctgcactttctaaatcatattctttctttctccaaacttattcactatttatggaaatgctttattgaaatgtggctggtaaatatccatctattagtttttcttgcagattaataaaaatatattatacttttattgtgttaataaatgggttccaaaaatcactgttaagtcttcatttggaagatattttaaaaagttttagaatattctgtttctgactttataaagcatgaagatacgagtttttggtgtctttattttttagattttgtatatattgtttcaacagcagaataacttagcaatggaaatgtttccaattatccaattttgaaatgctctattaggaaagatttttttttctctcgctctctttttttttttttttttttttttttaaagatgaagcctctctcttgtccccaaggctggagtacaatggtgccatcttggctcactgtaacctccgcctactgggttcaagcgattctcctgcctcagcctcccgagtagctgggattacaggtgcccgccaccacgcccggctaatttttgtattttaagtagagatggggtttcaccatgttggccaggctagtctcaaactcctgaccttaggtgatccgcctgcctcattctcccagagtgctgggattacaggcgtgagccactgcacccggccgatttttttctctttttcttttttctggaaaagctgaaaataattctgacatgttgctaaacatttttattttgtaggggcagagtgagtttttttgtttttttaatatcttcttggtagcatactacttataacctcctcagaaatatttagcaagtttggaactctagtctttttattttaaaaaaattgtgtaactcatctacatttaacaaatcttttaaatacatttcttgtggtaactagtgaatctgtgtggatttaaaaacaaaaaaaagattatgaggccaaggcaggtggatcacttgaggccaggagtttgagaccagcctggccaacatggtgaaaccccatctctactaaaaatacaaaaattagtcagaagtggtggtacacaactgtagtcccagctactctgagctgagaatgcgccactgcattcaattctgggcgacagagcaagactatctctcaaaaaaaaaaaaaaaaaaaaattcagtggctactctctatctcccagagtataggaagattctatattcatacagttaacctcagtgacatctgaggtaccttgttctgacttaattgcagcaatagtttacctgtgaatgaagccgttaaaggcttttgtatcagatgctatcactgtaactttgttctggaatttttttttttttgagatagggtctcgctctgttgcccagactggagtacagtgacacgatctcagctcactgcaagctccgcctcccgggctcacgcctttctcctgcctcagcctcccaagtagctgggactacaggtgcccgccacaacgcctggctaattttttgttattttttagtagagacggggcttcaccgtgttagccagcatggtctcgatctcctgacctcatgatccacccacctcggcctcccaaagtgctgggattacaggtgtgagccaccgcagctggccagaattcttttttaaaattccagtcaaagcagtcatttcatcagtggttacagttttcccataaagcaccttgtttcatttacagttaagaatacctcccttttaatacattgttccttggtatcttacaaagttgtatttcctgtatatttcataattacccagcaaataccctaagatgaaagaatcatctgtatttttatccaattgtatagcaaaccccacacactgtatttgtcctgatatcttcaagtctttagggttttctaagagcttttgactatacttaccaataaaagaatacatttagtttgtcaccatttttatttctgtgtataatttcagctatggtccttggctttttttagggaaaccttagcagtttcgacactaactttcgtacaattttgtgaagtgtcacattaaatagcctgtgactttagacataggtggaaaaattatagacgtttaactcttgcagtgaacacttaaaagcctggtggattatgaggactttgttcgtgccatcagattatatcttaaggtagagtagacatgtagagtgaggttcatctttaataaaaaatgggctgggtgcagtggctcacacctgtaatctcagcactttgggagaccgaggtgggtggatcacaaggtcaggagatcgagaccagcctggctaacacggtgaaaccctgtctctgatgaaaatacaaaaaaattagccaggcgtggtggtgggtacctgtagtcccagctacttgggaggctgaggcaggagaatggcgtgaacccgggaggcggagcttgcagtaagccgatatcgcaccagggcagtccagcctgggtgacagagtgagactctgtctcaaacaaattaaaataaataaataaatagataaataaatggtgtggctggacgcagtggctcacgcctgtaatcctagcactttgggaggccgaggcgggcggattgcctgagctcaggagttcgagaccagcctgggcaacgtgatgaaacccccgactctaccaaaaattcaaaaattagctggagcatgcctgtaacccagctacttgggatgctgaggcatgagaatcgcttgaaccagggaggcagagattgcagtgagctgagatccaccattgcactccagcctgggcaacagagagagactgtgtcaaaaaacaaaacaacacataaataagaaattgtgtaaagtcaatataaataccagtactaatattttatttttataccccaaaggattatcgtataatacaaacacccttcaagtacacatatcccactttggagactaatgccctaaacaacagggataatgatattgaaactggccttttagttaaaataaaagcaaagccaaaaataattcactttcctctataaatttatatttgggagacacatttaagaataatcgtcctggccaggtgcagtggttcatgcctgtaatcccagcactttgggaggccaaggtgggcggatcgtgaggtcaggagatcaagaccatcctggctaacacggtgaaaccctgactctactaaaaatacaaaaaattagctgggtatggtggcgggcacctgtagtcccagctactcaggaggctgaggcaggagaatgacatgaacccgggaggcggagcttgcagtgagccgagatcacgccactgcactccagcctgggtgacagagtgagactccatctcaaaaaaaaaaaaaaaaaaaaatcagctttggcttgaggtttgaagaatgaacccttcagtcatagactatgactacctgtcatagctcactaggaaaccctagggaatcatggaagggttattggttaaatatattatataaaggaacattttgctagttgctattgaccaaaaaggctgttttttttttttttaaatatagtctgtaattatttttgttgaaagatatttggaagatggtttttctcaatctataggagatacagttcgtagccacctgggatctcttataaaaagatactttttcatagtatactctttataatatgcataacatttcataatatacttttgataatatacataaaatttgatacataagtttaccaaatttattgaatttacttcagtgcatttttattagtcaagattctttggaagatatggaaagctaattcaaaaaagcttgagcaaaaaaaatttgttggctcgtaactaatgttcaggactggtctcaagaacttggttgccagatctgtgtttccaggttatctattagcttgtctgtgtctctgtgatagttttacccttttagagtggaaaatcttcctccttgtggtgctctggcttgcagaagaatgcctttggtctagcgccagcatatataaaatcctgtgggtgggatagagtagatgtggttgcatgtgtgctgactggcagtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagtgagtatctgactttgttttcttttaacctgctaagtggcattcgggaaacttccagagagtcatttttaggaaacgttggaaaatatttttaaaaaattcttgctgagttggaaaatggagaagatgagaaaaagttatgtatttgaatcattactgtgtcaaactttgataaatactgtataatgttttaaaaatgttttatgtataaaactctagttttcatcagttttcttagtagagctaaacatactggttgtatgaatcatatatggcagagttgttaggtgtttggttctggcaaactcagattgtttgagttttcctggctctaccaattacaaactgtgtgaccatttctgtacctctatgtcctgatctgtaaaatggagatgatctcttcctcaaggtagctatgaagattgagttacataaataaagcacttagaacagttcccaacatgttaacaatcccttagtaaatattagctgttatgattattattaccatgataatccaagagacatgaacattggaagatgggctgggtatggaggcttacgcctgtaatcctagtactttgggatgccaaggcaggctgattgcctaagctcaggaatttgggaccaacctggccaacatggtgaaaccccatctctactaaaaataaaaattagccaggcatggtggtgtgcgcctgtagtcccagtttctcaggagactgaggcatgagaatcacttgaacccaggaggcagagactgtagtgagccgagatcgcgccactgcactccatcctgggtgacacagcgagactctgtctcaaaaaaaagtaaaggaaaaagaaaattggaagctgcaaagcaaatgtagaatccttaaaggcattttgcactgtaatttattttaactgattcatatcaccgcactgccaggacttctaaagaccctgctgcaagttcagtgccatccatatgcttctgagattggtacagataaggagatgaaggggctgtagggaaataagaggcaaggtggtagggttttaactgagcatttttcttaaaatgttatctgtgaaatacctgagtttcacagagttagaaatgctaatcatctttggtttccagcttcagagtaagaggctgtactatatggtgatattaacattgtttccagtgctaaacattctgtgatgctaaattgagcacaggattttcaacagataaactgaagtatagataatcaacgtgagaatttgtggaattcttttacatatgttaaatgttcactgtactcatggtggggttactcaaaatgtagttgatataaggaacatgtgttctagtggcaaaaaaaatacgtatagaaacattagccattgatgtgaaaaattacagcattctgaaaagataatgtttaaaaagatagtgagctaggcatgttagggcatgcctgtagtcccaactactttagagactgaagcaggagaatctcttgagcccaggagtttgaggccagcctggtcaacatagcaagaccacatgtattaaaaaaaaaaaaaaaaaaaaaaaaagatactgctgctgcataacaggatttgaagcttctatcttacacatagtactttttagttacctggtataggagattatcatgagaggactgtttttttttttatttacaggtaatttctgaacagggaattagcacaaaattttttaaaacagtaaatattgatatctacatgaaagctgatgtattttaggaattttttaaatcttttttttttttattttgtaggttgtttttgttttagcctgttgagagagtctgcaaataaatttaatgagtagtctaaaaactaacttttttttgattgctatatcctagctcttttatctttggctctcttctccttattaggatgtgaagtaattctcaggagaggaaatgcatctagtttttacttgatatcaaggactctaaatcactggcttcagttttatgtaaactggaaatgtaaggaagttggtattttggatggtattttggctggattctacttgatgagtgtttgacccaaggtgctccttatatctggaaaacatttgggattgctgatagtttgggaaactaaatttgtggttctatttcttcaagacacagatagtgtcgtttccacctgatactcattaaatatcagtttgacaagaaatacattttgaaattatgttcttcatttccttcaatgtggagtactaactgtgtttctgtcctttaggcatgtgattgtgaggacctctcccaatcacaggtacacatttacactgaagacacatccatcggtggttccagggagcattgcattcagtttacctcaggtaactcagatgttaatttgttctcttctgtttttgaaagtcatagaatatgaataatctgttcattttaagcaagcatcaccctgtgactgtattgattcatattgaagaaaaatatctaagtattatataaggaatttaaagatacagtcttcttttttttttttttcttttttttttttaagacagggtctcgttctgagacccaggctggagtgcagtggcacgatcatggctcctggtctcaagcaattctcatacctcagtctcccgagtagctgagactacagtcttgtaccactgtgcctgactaattttaaaattttttgtagggatggtgtcttaactgtgttgcccaagctggtctttaactcttgggctcaagtaatcctcccaccttggcctctcaaagtgctgggattatagggtgtgaatcatcatgcccaacctaaagacagattcttaattgccagtttttgctatggctgccttcttttggcttgattttttttccctaatttttaaagattttgcagtaaaatcagtcagctatcacataaagcgtcaagttattttaatgttaactgccagggtaatagaaaagtagaaaacattttatttgtgaagttgatatctaagaatggtgattttataatgtgatggcgttatactaaagaatttggaaagagtctcaaattacaacataatttgctaggctcccataacaactggatgggttgtgattacagttacaactgttgatggattctgtagaatccagagaattagattgcttagtgctgtcccaggcacatcatacataatataaagcaccaagaatactagtctgtatcctcttctcccttatcattttactcaggctgctgactgtccccagtcctaagtaatgtaaatggaattcctacctcctcctagtatgctaatgagcattggttgacttccctgaaggtttagagaaagagatcaaacactcatttaagaactattaggctgggtgcaatgactcatgctggtaatcccagcactttgggaggccaaagctggtggatcacttgagtccaggagttcaagaccagtgggcaacgtggcgaaaccccacctctactaaaaatataaaaattagctgagtgtggtggtgcatgcctgtagtcctaacttcttgaggggctgaggcaggaggatcacttgagcccgggaagttgaggctgcagtgaggcgagatagtgccactgtactctagcctaggtgacaaagtgagaccctgtttaaaaaagaaaaaaacaaaaacaaaaactattagatgggccaggtacctcacgcttgtaatcctagtgctttgggaggtggaggaggatcgcttgagaccaagaattccagatcagcatagcgagacccttgtcccccgcactagtctctacaaaaaaaaaattttttttaattagctgggcatggtggcacatgcctgtagtccaggctacctgggaggctgaggttgggaggatcacttgagcctaggaagtcgaggctgtagtgagctatgattgtgccaccatgctccagcctttgctccagagtgagattctgtctcttaaaaaaaagggaaaaaaaaggaactattgaagatctcttgaagccctcaaaaattacaggaaattttcacttactattccacctgtctgtttgatgcctcttcattatccagaccactttcacgtttgtttctatagattaaaagtttgggatattccagggttctccagcttttacagagttccatttgggattctgattgttagcaatagcttgaggtgtgacagtttctccttgtctctgttttgtaaaaaaaaaaaaaaaaatttccccgacattcactgtaggccagcctctattctaggtactttggcatgtgttagctcatttaattctccaaacaaccttatacaatagctactgttgttatccctaaggactgttgtattagtccattttcatactgctatgaagaaattctggagactggataatttataaggaaaaatgagatttcatggactcacagttccacatggctgcagaggcctcacaatcatggtggaaggcgaaggaggagcaaagtcatgtcttacatggcggcagacaagagagcgtgtgcaggggaactgccctttataaaaccatcagatcttctgagacttactcactatcatgaaaacagcatgggaaaacccacacccatgattcagttacctcccactgggtctctcccataacacatagggattatggaaactacaatttaagatgagatttgggtgggggcaaagccaaaccatatcagctgtctttgggattgaagtacagaacctaaatgtggcttccttgtgacttaaagtctaagcttaacgagcatggtgctaaatttcaggttggccagaagtgggatggggttttacagaagaggtcttctgggggaggtgaagggcagagtggagggaaacaggatgtggtaagaaagccacaagggagagcacttgttgcacatattcacagttcagtgtcttctaaattacccgccacaaagtctgcagtgtttggatgggcaggtgaactactgattttcaaccaaaaattgtttttctcattgttctttggagtgttatcagtaattactaattttgaatctataccaagcaaaccccagattcctgcctaaacacaatctggcctgccttcatacttcttgccattgtaaacagtagggatttgggaaagcctgaaatctagctgtaaatgtctaaaaatcttctggctagtatacaaagagtagccatgaccatctaatgatttcagtccctgactgggtttcaaaatagattttctgaccagttttaatttagtcttcatgaattgaatgtcttcctttttgagatactgtaacaaacagtaaaactaactgcagcagtacatttagaacactgaagtgtgatctgatacagtgaagaccttctgtagcatcatattgtgcaaaggaacatcctcctcagtggtgccagctttactgcaaaaggcaagctttgcacgttttgaaacagatgttcagatgtaaactgtagcacatgctttactttcctagggtaagtaacaaagaaccattactgggtagcttaaaacaacagagatttattctgtcaccgttgtggaggccggaagtctgaaatcaaggtgtcagtagagctattccctctctgaaggctctagggaagaacctgttctgtgcttagcttctggtgttgccggcaatcctttggtgttccttggctgtagctgcatcatttcaatttctgcctctgctatcacatgatggcattctgtctgtgtgtctatgtctctttcttagaaggacaccagtcatatcggcttagggttcaccctaattcattatgacctcatgttaacttgatacatttgcagagattgtatttctaaataaagtcacatccacaggtgttgggggctaagacttcaacatactttggagggggagagcacagttcaaccataatagcataccatgttttgatctttgagtgtattcctaaaattcattaaaattcctctttttctcttgtctaattttgatggctttggttttaagtatctttttttctcctttacagagaaaatgggctgggctttctattgggcaagaaatagaaggtaggtatattttttagccacctgataaagattttctatgtgattttctcacagttattgagatctgtacaattttctattactagtggtcagatcttaaacattcattgtatcagaagactggttacatctatgagaatgggaaggaaatagttatggtacctctgttcctatatcttttatgaagtgtgtgataaggtcgtcatagttcaaggcaaggaaagcaatttatgacttccagttgggggcgtggcggggtggaaagactaagctgctaatagataataagccaaagaactaataagcaaaaagtggcattgtctcaggcaatgtggcaaagttaggaaatggagtatgagtcgtctttagtcagatgattttatgtcaacttcatggatacagtaggggaaggaaagaaaatgcaagtgtaattaaaccagcttttcttctgcttgtctttaaaacttaaaaaaaaattgtatttatagaaaggttgcaaaaataatacgaagaatttctgtatactacctttacccagctttaccaattgtcatattttctttatcattctggctccctgtcttcctctctgggtctctgtctctctctgtacacacacacacacacacacacacacacacacacacacacacacatcttttatcctactcctcatttaggaacctgacaacttgtaattttttctaagttagatggaatttaaacattggggttattttattttattttatttttgagatggagtctcgctctgttgccaggctggagtgcagtggcgcaatctcggctcactgcaacctctgcctccagggttcaagcgattctcctgcctcagccttgcaagtaactgggactacaagcacttgccaccacacccggctaatttttgtatttttagaagagatggggtttcaccatgttggccaggctggtctcgatctgttgacctcgtgatccacctgccttgacctcccagagtggtgggattacagatgtgagccaccacgcccagccaacattggtgttatttttagttagctttttctttgtggaagtatgaacacttgttaaatttaatgagaaagtggggtagtatgtagcttaggtttctaattttcataaattaatttttctaaatatgaggctaagagtacttaaaactttgaatctagatattttctattgtgacaagatacagaaattcaagattataaattttgatgagttgagaaatgtgttttgcggtttaagttataaaagcattcttctgctaacagaaatgcttatctggattgtaaagtcagatctttaaagaagtggctcaaacagacttaataagcaaaattgtaaaacccagtgataggtgggactaaagtggagtaagcttgagggaaggtagggttttggggcccaagtgatgtggatgatgtagccataaagatagaaaactggtttggtttaagtagtgatgtagaccaagataggataggaggtgtggtttgaaggagtgctcaagtattctggaatgggagttccgtaaggtgaaacattttagtcaaatcagtgattttagtctgagggaatcttctggaggaatcatttagtcggtcttctttccatctggcaatgccatattttaagtgttacaggctgatgttttgaccactatatatacacctattattgtaaagtccaagtttattcaaagaactggatacacttattttttgcttataaaatctttcttattagtcttttatattaaattactattagccgtaaaataagaaaacattctcaatcttctttgatccaggatgaaatcttcaggactcttgtccctttgggactgaccatggtgctgactgtggtgctgcctgggatactgtccatggtgctgcccatagcacttgaaattgtaacagtttggtcttttctatttaggaacattggccttaaattaaaatgcatttgaaaactacagtcagtgcattactacagtcagtagtaattatatttttatttatttatttttgagatggaatctcgctctgtcgctgaggctggggtgcagtggcatgatctcagctccctgcaacctcctcctccccagttcaagcaattctgctgcctcagcctactgagtagctgggattagaggcatgtgccaccacacctggctaatttttgtatttttagtagagaaggggttttgccatgttggccaggctggtatcgaactcctgacctcaaatgatccacctacctcagccttccaaaatgctgggattacaggcatgagccaccacgcctggccaatattttaaatatacttattcaaatttctcagtatgaagatgacatgaatatatgtatatacacacatatatatgcattatgacattatgatattgttttggtgtctttaatgcacaaaatggtattatactgtacaaacctttctgcagtagacttttgtcactcaatattatgttttcaagggccatccatctttttttgagatggagttttgctcttgttgcccaggctggagtacagtggtgtgatcttggctcactacaacctctcctcccaggttcaagcaattctcctgcctcagccatctgagtagctgggattacaagcactcacccccacgctggctaatattttctatttttattagagatggggtttcaccatgttgaccaggctggtcttgaactcctgacctctggtgatccacccacctcagcctcccaaagtactgggattacaggtgtgagccaccacgcctggccaggccgtccatctttaataaatatacataaagttggtttttgtttttttgttttttttttgtttttttgacagggtctcacttggctggagtgcagtggtgcagtcgtggctcactgcagcctcagtacctggctaattttttaattttgtgtagagatagggtttcactgtgttgcccagtctggtctctaaatcttggacttaagtgatcttccctccttagcctcccaaagtgctgggattgcaggtgtgagccactgtgcctggccaagttttaatttcaataaaaattgctgtaaagtattctacattatgaatatactacattttattcattgttctcctactgataaacatttttcaatgtttaagtactataaataatgctgcaatgaacctccctgtagatgtgttgttagacaaatgttctagcatctttctgggacagacatctagaaatggaattgctgaatcatcatattcatttttacattaatatttcaacctataaatgttttcaaactacatgagggaaacaactaagctcttttgcctatcaaagttactcagcatataacctgtactttctaggattttttttttttttttttttttgagacagagtttcactcttgttgcccaggctggagtgcaatggtgcgatcttggctcactgcagcctcgcctcccaggttcaagcgattctcctgcctcagcctcctgagtagctgggattacaggcatgcaccactgcgcccggctaattttgtagtttttagtagagacggggtttctccacgtttgtcaggctggtctcgaactcccgacctcaggtgatccgcccaactcagcctcccaaagtgctgggattacaggcatgagccaccgtgcctggccattctaggaaatgttaagaaggagcaagccatccagaattggagacaggagagtattctgaaacttttagccaaaatttgaacttattatttgatcttcagtgagttttatgttccttcctcaggctttgttattttgcttttgaagtagttaaaatatgtatatgtccccctttaaatacagaaatctgattatacaaacaatttcatttaaagagtttacagaaaatcggccgttcgtggtggctcacgcctgtaatcccagcactttgggaggccaaggcaggcagatcacttgaggtcaggagttcgagaccagcctggccaacatagtgaaatcctgtctctactaaaaatacaaaaattcgctgggcatggtggtgtgcgtccgtaatcccagctacttgagaatctgaggcacgagaatcacttgaacccgggaggtggaggctgcggtgagttgagatcgtgccactgcactccagcctgggtgacagagcaagactctgtctcaaatataaaataagagtttacagaaaatccttgtacataactcaagggtctagaatttaagaaataagtttagaacagaatttagagtgtgaaacgaccataaagacttatctagttcagtcttgatttatagatgtgacaaatcaaggcacagacaacttaaattatttacttggattcttctgattgctagcagaatctgttgaaacacacatactcaaagtccctttgaagaaaacagctttgtttgtaaaccactagaatctttgcaacagacatttaatactgcacagtgacttcttttgtttacctcttgctatttgacctcagtaactcacagaaatgccatgcctgttgttcaaagcaagtgtgaaaaaacagtctttgtttataacctgcttttgtggtgagaactgtagaagctcacttacccaatgtgacttggactggtaattaagtgaaaagttggttaaaggctttttcttggaggtgtggtccatggattggagttctgtattatcttttgtgcatacactttacccataatttccaggtggatttctttgaaatggctggagaacttagactttgtagagcatctgagagtgccaaaacctcttggatttttgtagagttcactcccaaccttttctaattttaatgcttatacctagttagcagtattttttttttctagaagaaacacttcatttaaaaaattttcccaaagctttcaacttataatatctattctagaatgtcaaagtcattgtaataacagttcaacaaccaggccttcagaagtttttatactatttaattatatttcataattaactgtaacaagtgtaactagcacagacagataccagaatgaacttggttgacccatgatgtgtagcaactcctgtctacaagctctgagcgttaggcaaaccataggctgatgggtatatgttggagggataaaagttggtcagctttctgatgactcagctcagtggaggttgcttacgagagctgctactgtatccttaaggggccattggtaaattttaggacaagtatcttcagggaacctaaagggaaaataaatgtgtgtgtgtgtgtgtgtgtgtgtgtgtgtgtgtgtgtgtgctcgtgtgtgaagccttattgaagagtagcaatagactctttcttactaggcgtaatcaagttgccctcctggggaaactcaaatgcaaaaatcctcttgaacttttctgggtagcctactctactctttcctaatagtaccactacagtatacagcactgtaaaattttttgctttaaaagtttgtttataaactggcatttataagtatactttttgagctgatttaagaatcaagtttttttttctagggaaatgcttctttgtaattatctgtcactagcaaaatttgttttaacatatatttttctaaaaatatgatatgtaaactgtgttgtagttgtacaattaaaggtttttggtcgaacagttattacatgatgtaaaatcatgtgtaacactttaatattaattacattgtaacctaaaattcattttaaaactttttatgtggcttgaacaggaattttcttatccaaagctttgtatgtatgctttattgcctcctttgttattagcatggagaccatgggttttctgttattgttgtttcatttaaacagttcatgaatatattaagcacctgaaagaaactgttagatgctgttaataggaagaggagttaaaaacctcgtccttgcccttatctacatgtgtacatgtagaacttactgtagttccctagatgtagcaggtgctcaggaaacatttttgtagtagtaaaaaagaaatgtcaaactctaacttgctctggagcaaattccgctagtaaacattgtttttcaagcttcttttttttgccttgcgtcctactttcttaggccaaaataattcatccacatcccaccttagctgtttttttgtgtcaaacaaaaatcttatttggaaatagcatgttatgccaactgtgttggggcatcccatactgtattgcattaaatgaggagaaagatgcagaggccatgtggggaggattgtgatcctgataagagtgggatgagggataacaacagagagactgccgttcaatatttctttctttctttttttttgagacggagtctggctctgttgccctaggctggagtgcagtggcgtgatcttggctcactgcaagctccgcctgccaggttcacgccattctcctgcctcagcctcccaagaagctgggactacaggcgcccgccaccacgcccggctaattttttgtatttttagtagagacggggtttcactgtgttagccaggatggtctcaatctcctgacctcgtgatccgcccgcctcggcctcccagcgtgctgggattacaggagtgagccaccgcgcccggcctgccattcagtatttctaattaattcagatggggaagaaaatctctagtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctagtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccacctcggcctcccaaagtgctgggattacaggtgtgagccatcacgcctggccaaatgaggaatttaagatctaaagaaggtaaatggtatgcccatggctacacagctaagggacatagttgagataagaattaattaaacacatatttgatagtacctagtgcctagtaccagtcactgttttagacactgcagatcggcagtgaacaaaatagatatgatccctgctgtcatagaacttactttctagttgaagaaaacagaaaataagacaggaataccatgtacagttaggtctctgatgaaagtagatcaggacaattcaccagagagctattgcggtgctgttgtgtattggatgaccaaaattgtgctcagattgcctagctaaacttgatggtttttacctttgcttttagttttagtatcctaatagaaaatgtttaggagaatgtttaatagaaaatgctttggtatttataataatttaaaactcagtagcatgtagaagtcagtaaatccatgaaagagaatctttcgtaattcagagaagaagtaaatatcttactccagatcactgtccttaactgtttcttctcatttgtggtatctcgtagtagcagaatggacagacagcccaacctgtaatatttaccattataccccagcacatagaagaagaccaaacttttagaagggactcagcaaagatttggtgaatgagtaattgagcattcagaagctgtctctgcacttgtagggcaagcattttgtactagtgatagaaaagcaggaattgtagagtcacagacccagggttgacttctggcgctctcatttactgtgactttgagccttgttgcatagcctgtttctgcatctcagcttcctcactagtaaaatggagtcgtagtttctgcttccaagagtgtttgtgaatattatataactggctgtagtgtttgaataaaatactaagaaactttattctttgttagaaatagtaaatgtggtactcttgaattactttaggtggcactctgacatttaaattagatattttttatccatgtggaagaaattttaaacatgagttttgcagtcattttgtaaacactgatcgtaagtgctaattcccttttcttcattggctgtgagtagtttgtttgaggagcagattggagaggagtatataagataaactggttttctgcatttgaaaaacattggtgatgatctgaggatcaaactattatattatgaagtgatttttctccccttacctcttttctacatagcttgtctttagcttcaatgaaaagctttttggcttactggtgaaggacattgaagccatggatcctagcatcctgaagggagagcctgcgacagggaaaaggcagaaggtagcttttatttctgatcatctttactagatcatctttataatgtaatttgtgcagattgattataattttcctatctgttgcttagtgatttttttcatattgtgtacccttttaagatagtagggagaaaaaattgctttcatagccatcattgttattaaaatatagcttaaaatgtatttatttgcagacctaatattaatgtaaaatgtagacgtatatgtacatataatttgcttgaatgcagatatttattgtaaataaataataagaaacgcattattggaaagatataggcatggaaataaggcatgtaagaattgtagaagaaagttatgagaaaagtaaaagtagctcagatgatagtctggaaggtttgctttgcccagagagacctcatttccccctcacttttggccttgctttgagaagtccagaagtttgctattagactactaattattgtctttctctacagattgaagtaggactggttgttggaaacagtcaagttgcatttgaaaaagcagaaaattcgtcacttaatcttattggtaagatttacagtttttagaagatttgaaatgaagtgggcctatttctatatgtaactcaactacagtgatttccaaatggggaaaggaaagaggggcatctctcttgagagagtttatcacagaagcatggggtatttcctgttggtcagtttgctgatgaaaacgtttaaaaccttcatctggatcaactttgtccaatagaaatagagtgtgagccacatgtgtaatttttaatttcctagaaattgcactaaaataagaaacaaattaattttttaacttttaattttgagataattttaggttcacagatttgcagaaatagctcagagaatttctgtatgccctttaccagcttaccctgatgttaatgtcttatttgacattttcaaaagtacaatgataagaaatgaacatggtttcatttctgctaactaaactacagattttattgagatttcaccagtttttccattgtgtccttttctgttccaagatctaatttaggatcccatattgcatttagttgttctgtcttttgagttttcttcagtcactgacagttcctcagactttgtcttttatgactttgagaactggtcagttattttgtagaatgcccctcacttggttttgtgttaaatgagatagcatcatcatttcttttagtgattaagtgatgaatgtgcaggtcaagtcttcccagcagattcatggttcagtcctactcttgtactctagcacaatttttgtcatattaaaacaattgcagcttattctctgagaatagtaactcaccagaataatgtgacattaactgggcattaattcttatttttggttgatttaactatgttgatgtctaccctactagagagtagagggttttcattggttgcacatcatcatgtccagggtcacttaacagtctttgagtgcgtggcctttatttcctggtccacaaattaccattcccccttattgttttttgttaattataaaatattttatttataaaatatggataggcattcgaaaacaattcacacactgtaaaatttggttctgttttcatagttttgtaatttgctttttttgcttagcatgtttcaaacatcttaaatatacacctataacatgatttttaatgcctgtatgtcattttatgaaggtaggatgtattttcctgttattgatctagtacatttatgaagtgacttctttgtattttatttttgtgtaccttttgttaagatatcccaagggagttgcataactttcataggtatttctaagtaatccatgggaaaaaaattgtgtagttaattggcattcagtaaattttgcccacaagagggcagtagagtgtaagaaaaaaatatttttcatcgctttccaaaggaaatcttaaggcctcaaaactctaaccataaaattatcatctagtataaacttttaaaaagcgttactttatttttaattgacagataataattgtatatatttatagggtacaatttgatattttaatacatgtatacattgtagaatgatcaaatcagcctaattaacatatcacctcaaatatttagcatttcttaggataaactttttttaatgtgacattttcttccctggttttataaaaaccatattattactttattttttgtttataatagagcatactaaggtacttaatttattctttgtttgaaatagtaaatgtggttctcttgagttactttaggtggcactctgacatttaagttagataatttttgtcctcttgagaatttttaaacatgagttttgtaatcattgaagtctttaggatgatttcagacttttgtgtccaagtgaagagaaagcaaagaagacatcaaacttgttcagtatatttccttaggctgaggggttatatgcccaattacctgtataagcttaatctggataaatatatgtattttaaaataaacttgcgttaggagacttcagtgactgcgagatttcagttgcatttctgccagctagtgttgtcttcatcagatatggcatttcttctgatcaaccgagttagttaatttagttagattgaaggttaataaaactaagttttatggactgatacaaatagactacagcataagtttagctagtcattttgacagtgtgttaccatatatggagatcagacaaagtagatagcatagcaaaacttacccttctgactgtaaaatcagctaagattatattgttcgttttgtatatgtaagggtagcttttctttattcatttaggatgctcagggagttctgtctgtctttttagacttagtgataaagtccttgtttcacatttgataatattcgtttgacataggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggtaagtttaaaaaggaaaatgttataaaatcttgtgttgttaaaaaaattaatgcaatgaagaatctcttttcaatagttttgaaattatttttcagacccattatttttgtctttttctttaaaaatgaacagataaattttctgaaaaactttataataccagaacttttaaaattacattttaattttatggggaaatcatagaaataagacttgtggtggctccattttgtttatttatttattgaagaatgcttttctatggggcatatttagaaacttcccctgacagtaataatactagtagtgactccattttatttatttatttgcgtaagaatgtttttctatagggcatatttagaaagttcacctgactctaaagatcactatgggtcagatgtaccctgctgaataataactatctattaggctgtgtgcattgttctgacattagctgccgttcctttttattgtactgttgcattacccagttagtacatcttcatacctaataaatgggtacttgcatatttttaaattaaataagtttgatccaaaaagacaaatgcaggatatacattggagtttctatattgcatacaaagaagtgcactattcgtttaccactttcttcttgaaggtttatttaatttatctgtgtgaagtgactttatttgcccagtggaaatgctgtcatgactgttttcatgtccatatcattcgttggattggaatgtgagcaacagaatatctgagaaaggaatgtataacataacagcttctggcagactattagtgtaaaaacagcatccaaaaaaaaatggaaggaatatgaatatattactccgctcatccccatcattctttatctttaaattgctactggaagataaaagtatatttattatagtggggataagaactgctttctaggcactaagtgcttggattgtattagccttctattgttggtagcctttctgcctggtcgctcactctgataaattacaggcacggcacacacctgttcactgagtaaaggtcgagtttggaattggattaagagaaaatgacagagaccctcatcacctgagttttatacaccttgaaatggcaatagcatactttttatctcaaagatacaaaggccacgtccattaaaagcagaattttaattgggaaaatattttaaaatgtggtagttcactatcttggtaatgtgtattttcgatcaagacatgaaaatattgtttaagtgtattttgggtaaaagcagggataaaaagatgattccaaatgttgtaagttattcttgtggaatgtttttactggttttcagaactgagatctagtgcaggaagagtctaatgattctgtttcttagaacatttatactgtttagccaaaaagtagaaaaataactgcattggtagtaagccgtctcttttaattataaatgttttctcactgtttggaagctattgaagataacagttattcagatactagtttgctatttgtgcattatctagatcctgcacttgaagctacgcgcaacgtcagtatgcgttgggtagataatgcgtaaaggagttggtctcacattggtcagtttgtgaccttgccagctgttggagagttttaaattaaatcagaacagatttggaatttgttagtgaatttcatctgtttctgatatccgtattgaaatgagctgaattacagtagtgtgctttttgttgtttttgatgtgttttttgactaagcactatggatttgaattttgtgagtgccactgtccagaaccttttttatggatttatttttctaatatttttacactaatttaattagacaaaaaatgaattctatccttttggaaaagttttttttttttttctctttatggctttttgccatcaggaagcatttgttaccaatttcattgaaaagacaaactagtataaagctgtcctggcttttgagctgaattgaaaaacttattttctttattctggatgaagtttctgggtatctaaaaaaaagtaaagcttcttcttttttttttttttaatggttaaatggctgagaaataattcttttgtaatgcatgtataattccctgtcttccaatagaggcttcttttttcctttgaattttgggggaattatatagtaaaatcctttcttgcactccaattacagtgtggttataaagttctccttaggctttggtaaaggtatataaataaaaatggttatattttgacagaatataaataaaattatacaaattatttttatgcatattctgtgttgtttttttttttgacatgtcaggtgggaacaacatggatttttttcccccactctttgttaactaaatagacagatctatatggtttggggattcagctggacactgagtatgactggttaaatcagttctaatttttaaaaaagattagaaaagaataatttatgtaggttatggggcttttttgttttaagcagaaaactttacttttggcttgagaccaaattactgtctttaccatggagtctaaagtgatgtctacttcgtaaacaggaatcttaactaagtggattttttgcctatatatcaattttcaaatttacaaagtgataaatttagaatattcttctcttctgtcattatgttcatcagactgataattatgcttctaggtaacagagttctttctttttgtctataaaacttcatgttgccttttcaaaattgaaaaatatagtttagctacgaacagaatgttgctgatgagatataggaggactaaaggacttaacgagaggcacacaattaagcagtaaaattagggaaccaatgaggtaatatacttgaaaataactgtcatggagtttccaatctgttagtttctctcttgaaggtctttcaaataggtagtgtataccttaggccgggtgcggtggctcactcctgtaatcccagcacttagggaagccgaggtgggcggatcatgaggtcaggagatcgagaccatcctggctaacacggtgaaaccctgtctctactaaaaacagaaaaaattagccgggcgtggtcgcgggcgcttgtagtcccggctcctcgggaggctgaggcaggaggatgtgtgaacccgggaggcggagcttgcagtgagccgagatcgcaccactgcactccagcctgggcgacagagcgagactccatctcaaaaaaaaaaaaaaaaaaaaaaaaaaaaaaaaagaagaagataatgtatgcctttctgcttttgtagttttgttatatttttgtagaattaaaatcaaggaaacccttaaaggagaaaggaagtcacataaagctctctagactgagggataaaggaaaagggattatttaggggaatatcaatttagacttttgtttttgttattgttttaatcagagcaactgttgagttttccccttgtctgaagcagttgagctcacccaaacccaagtggggcagcccttccttggaaggatatgagagcaacgagcgaagaaaactaaacctataccttgcacttagtaaataccaaatagatatttagttagaatgccttccaaccccccacaaaacagatttttaattaagaattaccttaaatccataattttatgggctaatagaagccacatttgagtcccagggtagaaatgtgaacatcaaagctggtatctggaagtatgggtgaataaattcaacagctgattgctgtctttcagcatattcaggtgttaactgaatagatactgaatacttgtgttcggacatttaccacacttattcccctgtatgcagttttgtggacagtgttcaggataaataaatgattgattacctcagttctcactgtagctattttgttagcaaagatagcgtttctgccaagaaacttcattttttcagcatccctggcaattctctctaaattataaatgtcaaagcaaaaaaacacatcgttttcaatgaacagtggaataattgttaaagaattagtcagcatctcttaatgtaatcctgggaataggttcacatctacccaaggaaagacctagaaggaaaaggatgtaaagagggaagacctcagcctcacactgtctttcagtggatctgtggggtgtagatgttcaggccacctagtggggaggaaagccacttgttatggtcttgtgcccccattctttgaaactgacactgtgttctttttggtctcctttccccagtgtctccctctgtaagcccattttcaatcgtatttttaaggtttcttttgaaattcaagaggaaagcaactcttttctgatatcataagtgaaattgtagttactctatgaaacagaactgctgagaagataaggaacctttcaatcacacagacatctttcacatactaaaaacagtgcaaataaaacatagtggaagaaagggcactaaggttttgtgcatgccatattttggagagagggagttcttgctaagattaacataaacactgacactcttaaaatgcattttcacacccccactcatgaggagagattgcattttaaatgggggttaagacatccaggcgaactccagggctctgtaaaaggaaccctaaggctaaagagcttatctgaaatttgaaaaaaagaaaaaaaaatgaagccttctgacattcatctttttttcttgtattagtcataacttgcttttcagctatattttaggttttgaatgccaacctgacatctgttcaagtctgcctgtaatttattagcagaggaaaagacagcagttgctcactagttagagatgcaaaatttctgccttcctgttctccactaagtacttatagatgatacctggatacgaagaatgtaataatttactgaaaacttcaggtcaggaaatttataaagatttttttttaattagaagaataaaatggcttaagaccatgtgatttcaaaaatctctagatcaggatttagagacaaaacatagaccctaaaaaatactttagataactttctataaattgtaatttttttaaccttgaattaatttttccattggttttaaatttttaagttaaatgtatatttgaacagtagttgtgcttatatctgaaagtcaaactgtatgtaaattcacctggcattttgcatttatagacagactttaagaaacaaatcttttggagaggtagtgctgtctacagagtcaccaaatggattagatttcctggcaactacagttgagttacttacagatcaacagttgggtcactacaaagttgagatctaagtgttaacctgagtgcccaccagtaagaaaccggttagaggcaatcttaaaatgatatagctccaaatgtagagacatgtttgtgttaataaaaaatatataaaagcaaatgcattctaaaaatctctaaggacatacattaaattgaaaaaaggtttatggctgaatgtggtggctcacacctgtaatcctagcactttgggaggctgagatgggaggatcacttgagctcaggagttcaagaccagtctgggcagcatagtgagaccttgtctcatttatttatttttttaatttaaaaatttaatttaaaaattaaaaaaagtgtttacttccatggaagggaagctaagatggggaataaagggaaagttttgttcttttactcaattttacctttatgtctgaatgttttattgtatttctaatgtgtgattttaaaagccaacagacaaaagataatatcacagtatgtttcttggggtgactctaccatcagcatggaaagtcagcaggaaacaggtacatccttccgccttcatgaagttttctgtggaggaggagagtgcagggtaaaaggcctggattccaagggctttgctggcagccccttagagggtagacagaacacctatcctatttggtcaagaagagaaaaagtttctccatatataacaaactgctttcccccagaatgttctgcattatagtaatggtgtaagtagtctgcccttcaaacatgagaacatttgcatccaggcctttaggcagccaaggcagcattaaagaagaaagagtgggagcagagcgagctgagggagagcagagcttctgacatttgaggaactgggcgtgaatttgtttttagtcttcaaaaaccattctcttgaggaatcgaattcccatgactcctgaagtgaagcggttggtgttttctcctgcgttactcccatacgtaagttggtgattataatgagggtggtggctaatacttatataatgccagacgctgttctgtgtgctttattattgtgtttattaatcctcacaacaaccttcagaagtagacactgtattgtctccatattatggagcaggaatctctgtctcaaaaaggtgaagtaatgggtccaagacacacagctagtaagtagtagagtcagatttgaacccaggcagtcgagccccagatttcatttccttaaccattacatgttattctcccatgaaagcccatcgtgtaaaaccattttaatgggctttctagcttcacttttttggggacctttgaagcaatcattgaggcagcctttgttctagccaagggccaaccatggcaccattgagattttgagctgtataattatttggtctggggactgggtgtcctttgcattgtaaataactaacttttctagtaatctgatgtgttcaaattgtcatgagctcaagagacatgaagatttggtggtaggctgtaatacctaatgccacttttttcatgtgttttttgtcacgtgttgtagcagaatacaggaaggaaggaactggaatgggtgtgtcagagaagctgtcttaaactgtcaacctggagagggaacataaatgttaaaattaaataatcattaaaaaattaagcaacgtaacaagtgatatcaaaggccagtatttgattaagtgccagatgagcagtacaattgataagccctacaggaactgaaagggaatcacatcgagaagacttcatagaagaggcagagcttgagtaaggccttaaatgctgagcggttttggataggaggagggaaggggatagttgtccatatcctgggaagagtgacagactaaacacggtatagacttcatgacttagaccagtctaacagagctgttgtttggaagaaacaggaaataggattaaaaagttagttttgggttgggttgtggaaatctgtgaggagatgtggactctttttaaagtactgtccctgtttaagcttccagacagactcagaaccttccagacagactcaggtgcttctcctgtgtttccctgcaccttgtatatacttagaatccagctgtgttcttaatgtaattattcatttgcattacactcctaaggcagaatttcttaaccttggcactattgacattttaggctggataattcttagttgtagggcgcctgacctgtgcatcataggatgttaagcgccatccctggcctctacttgatgtcagtacttcccttcctcaccactccgagccccagtgacgattaaaagaaatgtgatgaaactgtcctgtgttgagaaccattgctcaaaggcctttgaaggcacaactgtaatgtcttcttatccatgtattatcaacatcaggggtgttgggatgtaggttgcaggtcattgttggaccatgaaccactgttaccagtccacaataagacaaatattggaaattaagaataagtaattacaaatgtttatagcaatttgacattatcacaatttttttaaaattatattttacaaaaatgttggtctgcaatggattggaaatttaaaaggaaaaaaaatacagctggaccttagcatacatagtttgagaagcactggcctatgtaaatatttgcaaaatgaatgaaattttttgaacagatgccttagagaaaaggtgaggcgaatagtcttagagaccagtagactattgctgtccagtgtgtggtacttagaatctggattggggtgaaggcaacaggaatggaatgggaagaaaatacatgaaaaaattgcagacatgaaactggcagaatttggcaatagttattgtgggtgacagaattggaggtgagactcaggtcttgtgagaaaatgttggaaatgagaaactcaggagaacatagttttggaaaagtagagaatatcattgcacatattttcaatatcgtgaaaggaaactggaagctgaactgaagagaggaagaattactggcatttcaatttattgaagcctagcttcaatcagtctgcacgtgtttaggaaacacactgttgactacttttgcttgaaataccctctttacttggcttttctcactccaagcatttctggttttccttttacctctctggctgtctcttttcaacctcttttgtgtcccttaaaatgttggggttcctcaggagtctgtctttgacctattatttttctctaattattctcctccaaattaatcacatctgtttcatagcttcaattagtatctttatgctgctaactctcaaatatgcatatgccacctcggtctcagtttagaactctggatttgtaccagcataatgtgttgggtatttcatgatcacatagtaagcttgaaattaaacacattcagttgccccctcagtcctctctaaacatgcatctatatctgtgttttctatctctggcaatactctagccaaaaatctggacacctttaactcctctctttccctcacctcccacttccagtaagtcgcagaatagaccgtcaattctgcaatctccgcaatctctctgaaatccctccagttctctctacctcgccctgccactcttccttcaggacaccattatctcttgcctgaattgctccataagccctcagccttgcccttctctaatccattctccacactgtaactggagtgatttttataaaaaggcaagtctgatcctgtcactgcactggttcaaactctttagcagcccgccttaactccttacatggtttacaagccctgtgtgatctggctcctgctaaactttcttgcttcgcctctcagcccgtgcccctcccccatactctgggttccagccagcctgtgctattttcagttcctctaatttgccatgctactttctcttacctctatatcctagggttatttttttttgctttttttttttcttaaccatcttttcatccaattcctgttcactcttcaggccaaagctttgaactcactgtttctagaatgagtaggctttaatgttcctcatgtgtgttctaatagctccatgttattttatgcattattacattgtattataattgcttattacatgtctgtattccaagtcctctctccatgtccctgccctcacaaacatagtataccttcagtaaggaataggccttgtttattttggtcactgtcgtattctctcctcccggcatggtgtctggcttataagttttcaggaaataaataaatgccaggaacttgattaatcttgattaattaaatagaacacttagacagtttgatccaagccctgccctcatgatacttacagtctgtgtgggagtaacactgtatttgcacatcccaaagcagtactgtgtaaaacataaggtgcattgtgaaccagattagcaaagtaggccacatggagaagcagcagatgcatttaaagagcaagactgagccatatctttaaaagtcaaagcagatatgatgtttataattcattactaaatccatgtagatcctcttagattctgaatttaggaaagacctcttggattggtcctgaatggcactaggctccagaaataagaaaaggaagagtattttcttgggtacttgtgagctaccatttgcttcattgggaactgccattcttatgtaagggcactataacaagagtgttcacatttaagggcatcaggtcaatattgcgtctgtgtgagtttgtgtgcatgtgaatgcacacatgtattttctatttttaaatagaaacacattataaaaataatgcatcctcataaaacagcacagatagagtaaaaagtgaaatctcccttcattctacccactccagttttactccctctcttagaggtagacactgtaaagagattggtatgaatttttcaaaccctttcctaagtatttatacaataatatataatcaatccattcattcatttattgagacagggtcttgctctgttgcccaggctggagtgcagtggtgcaatcatactccgttgcagcctcgcactcctgggctcaagtagtcctcccacctccacctgccaagtagctgggactacacccagctaatttgtgtgtgtgtgtgtgtgtgtgtgtgtgtgtgtgtgtgtgtgtttgtgtagaattggagtctcactatgttgctcaggctggtctcagactcctggcctcaagcagtcctcccgcctcagcctcccaaaatgctgggataacaggcatcagccactgtgcctgacttttttttttttttcaacctagtagtgtatcttgggtttttttctgtgataaagcacacagataacattttattttttaaaaagttaaatagtattagcagatctgcatccacacaagtcccgtcatggtaagttagcgtctcttcctcagcagtaagaaggctcctaggcacacaccagaacaaggttggcattgcgtctcctttctactcacttgtatggccctaggcttctcaatgcggcagggccctgggcgctcagctacttgagccttggtacccttgcctgaaaaattgtttattggtaggtaacattaatgtgtgtaagttttctaacacagtacctggctgactgtcaaacactccatggatgatagttacttggtatgattatattgccaagaggcacttttggagctctgtaaaaggcaaaaatttataacccaatccctttaatctaatgttaagatgtgttttcttcttatcttaaattttgttgctgttgaaaatagttaacacctgagattttcctcctatgctgttttataattacccattttgaacagtgtttgttgataaggtagtcaaggggacacttcgaaatattttttctttatttgtgaagtcatactttggctgatttatatttaatttttatcacattacatcggagaggagcagataaattttctatcacctctataaattttctatcacatataagaaagtgtatcttatatgtgatacactaacttggaaaaacaacagctatcttgatagacacaatagagaataggatgtcagaggaagagaagaattagaatgttaacaataatgctagtaaaaagctacccaggacttaaatggtattatttgagagtacttctaccatgattcaaataagacttgccttggaattccatatgatttgttacttagagcagtctacctttaatatgtttaatatggtcatactttaaaaaaaaaaacctgcaagaaacttgggtttcacgtttttgctttttaaagaattaacataatgttatttcaggtttgtaaaggaagttacagaagatagcaataaatcccttccatataccattttagtcatagtgcaaaattaggcattgaaaattattatgggtactgtattagatattcaaagatttatttgtggctttgacttctttaccaacacctctggctttaatacagtatcttttatcagagcaagtaatagtttgaatccttttcttacaaatcctctttttactcaagtgactgcaaacttataaagatgcacacatctgtagcttgaacgtctatgctatttgctcaagtatttacttgaatttatcctcgatgatatgattttttgaagtgctttgattttaaattctatctagaatcccatcatgagggagaaatcttagcaagacttaagcaccttttcataatgactggttactgtaggataaacctataattagtatgttgctaatccacacgttagatatatcccatcaaatttcaaatatacacaggagaattatccacattgaaggttattagtgcattccagggacatttccatgttgattcacaactacccctttaccttacactttcctgtgttactagacgtctctttctgtaaaacttctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaacccttttttttcatgttatctagaaatgaatctttaaaaaaaaaaaaaaaggaatgggttgaacttataatattttagcaactcataaaataacttgaagaaaaagatcatttggaaggagagacaaaacagactgaaagacattgtttaaatttatgacttttattatcttacttgaatgctatttttgcccctctcgctattattaaaccctttgcttcctgttttcagttgctcctgtcaaggtatgaatttttctttggatgattgtcatctatttcatattatctagtattcctctctattatgagaaaatcaaaagtagacagtgtatctatagctatagatttaaatgcactaaggtaattatatatttgaatcagagacctaaggaataatctagtgtagcatttaccaaatttatttaaacttaacatgcttacatgaagacagacctatttatgtttccaaggaacaccagtttgagaaatgctgatcttacctgtgtcattcttattttgtagatgaggacattgggacctcagaagaataaggcaacttatttaggctaaagtcactgcttgtctactggggctggaatccaggttgcttagtctggtgccctttaggcttcatgattcagccacttaagacaatttgatttattgttgggctttttaattctagatttcataacttggatatgaaactgtacttcccagtctccaaaataagcttcactgttttctggaacgtgaattagattcagaaagccccttactgcctttagattattgcagcctccccagtgggccccagggatccaggaaaaatatctttgtttttcacctagtcctctcctcagcttttagagggactcttagatctatgtttatgaaaagacttttattagttcttatagttgtagtaatgcatgtttattgtagaaaatttcaaaaatgtagatgaataagaagaataaaacaatcactcagtgtaaaaaacaaaaaaccctgaaaaagtaccattaatattctggagtatatcatccagctagttttagctgtatatacatagaaccaaaaaaaaaaaaaaaagcattttgctgttttataactggttttctccccactcagtaagttaacagtttttcttaaatattctctacaacattctttattttgtagaatgataatgctgtggtttgtttaatcaatcccctctagttagaaattgtattcagttttttactattatacactatgtttaacaagcaccttagaaactaaatatttctacacattcatatttctttaagataaattcctggaagtagaattgctgaatcaaaaaggattcacaagtgtaaatgtttttgacatgcactgccaaatttagacttcctttttgaaaagtcaaatgttaaggagatcaaagcaatcactaagcaggtactctggaagagaaatagaaatataaaaaatataatggtttcatgagaaactaatagacaaggtttcaagagacttggagtctagttttggatttgtcattgaatggctgtgacttttgggtcttagtttcctcattataaaaatgggaagatagactagaaatagaaactttttcagaatagtcaccttatgaatgttgtttcagtgaaatataaaggtctgtacataagttctgcagggaagatgccatgtatttgctcattcttcaagtttcagcttgattgcctttggaaggtctgtcacacttaacgtcctcctaatagaagtaattgttttactttttggctcctcatagccctttttaaatgttggttctgtatagttgtatctttgatttttaatattgaggtatttgtaacagaggttatcttactcatctcctgaaagcacttggcttagcatagttcttgggtatataatagagactcagtaagtatctgtggaagttgagagtgataccttgttccccagtgtataacagcaaagcctagcctcctcctgttgagcattgtctgttctcgctttgaagagctcaccacatttcttcagtttgtttttgtttttattttattttatttattttttttttttttggcggggtggggtctttcctattcagtaacacagtggttctcagtctttggtgtgtatcagaatttttttttttttttagagttttgctctgttacccaggctggagtgcagtcgtgtgatctcagctcactgcaacctctgcctcccaggttcaagcgattcttgtgcctcagcctcccgagtagttgggattacaggcacatgccaccatgcctggctaatttttgtatttttagtagagacagggtttcatcatgttagccaggctgcccttgaactcctgaccttaagcgatccacccaccttttctggtattacaggtgtgagccaccctgcctggcccagaatttttaatgttaaaaaaaatacagatttccaggctctcaagtacactgaatgtgagtgtcaggcacaaagccgagacacagcgctgtcaatagctgagctctccttggggttttagctttgtcaggcaaattgatattcaagttccaggtctgccacttaccagatgtgtcttccccttaccaggggaaggtcactttaccactgtaagcctcagtacctcttccttaaaaagagggtaaaaataataccttagctcatagttttaaaaatgattacgtaagagaacatattaaaacacgtagtatagcccttcccatatctgcagttctggccttgatctgtaacttcttggatcttatatgcatttattatttatttgtttctttttaaaataacatttatattttttcaacttttagaggttaatatgttcattatagaaaactgaaaaacacaagaggcatataactaaaaaatcatccataacagaatcagtttacattctgatgtatctttccagtccttgtatgtgtatacatatatacataactgagtatacctttttacatggttacacttatatagtatgtgccatgctttcttgcatatcatgagtacttgagtatcaaaatactcagggctttaggattcagacattggtaaatattcacgatacattttcttatcttttgtggggacaaaaatatcttaaaaaacaaaatggcaacaggtctctggaaatgcatattggcaggtttatagttaaatactgtgttcacttaatacccaatataaaatgagatacaaagcagtcaagtaagtataatgcttcttagatagttcagtatgagatctgcactattaaaatattaccagaaatgatgtttctacttaattatttaacaattcatatagtattcacaaagtataccaagaaaaaagcacacatatgtcagtggttataatcagattgtaaatatggacatatctatatatatctcttcccttacctttctttctgccccttccttagcaatccagtacgtactgatgtatactgctcataggtggtttaacattgccatttccaagatgcttcttttctaatgaaattaatttactatctagttaattcactagctctattttatacattgtcacctcataacatctagaaagcttagtgttgtgaagtaaggactgataaacagaggcactttactaaaaaatcacttcctagaactgtggctacaatatgaaactatcttctagatatgaacatacttgcaaagaaccttccttttgcctttcttcttccttcttcagctcaatgaataagtacagaaatgcatatagctctacgagatgggttaacaacagtcactcccagacaacaagccttgctaaaaactctaacaagaggacatttatcaaagaatcattttacttcttaaactttcagcatactttgggcacttctcagcattggggccttgtttgtcctttgcatactcaacaatgctaagtaaatgcacttgcagaacgacgagtagataatctgcatttatctcaaaacacactggcacagaactcttccaccgtcacttcctgtctctcccacctcctttactacccaatgagcaaagaatatgtagctcaaagagataaaagtttaacagttccattctaaagacagtcattcctgttaattgacataaacttacttaaagtgtgttattttgtgaagactacatgtttcaaacgtctactgtataatgatagcattgattaaattgtgtgcatataacaaaggctataatctgaaagtatcttcgaaatatgaatattatagccaagtacacttcaccttctcacttccttcttatcattatcagcccaaaggacaatatcagcgttccaaaagttgttttcagaagatagtcttacctatgaagttttcgggcatacaagaaaagtatataatatgttttagttcatcatctcttcttttgtcaaacattagcaacctctttatcatctagacaacaagatgtaaaattaggacttgcttgttcattgtacagataaccctcaatgggttatgtctcagcaaacccatcgtaagttgaaaatatcctaagttgagagtgcatttttgacttacagtattttcagttgactatgggtttatcttgtcgtaactgattgtaaatcgaagagcattaccaaatgcatattgcttttataccatcataaagtaaaaaaaattgttaaaagtcaaaccagtttaagtcggggaccatgtgtatacactatgtgcacagcaaagtaaaataaaatgcacagaacatgcaggtaatcttgcctaactacaaacacatggtatagaaccctttattccttcctacacttcctttgccttcctcctccctcagtccacaagcacagatctgtaccactcaaagaggaggtctaataatcccatttccgaaagacagtatttcattaaatttattaattccttttatccaggcatttagtggtcatttttagatgacctttaccacatatcttcagatgctttcaccgtccgccataagaatttttactgaaatgaattcttgaaatgtttaaaactttgttacattctttctcgttccacaagtagttatcccttcccagttacctttcttttttaggtctgtggagtcatgatacatctatccccttttcctttgtttttcatgcatttgtcaaatttattattgaatactcctaaattttttctgcctttatcatttgttttttctttttcattgctttagtcagttacccttgcactacagcagtagcctctttattatcttccttgcctttagtcttcttcctttccatcctggaatatttatttcagagcttactgtacaaaaataccagattctatcagagaacatcaaaggaatcacagaatctcagtattgcaaaggatcttagccatctagtgcacacacctgttttttatttgaatctcttctacatttctttttattattattattattattattattattatttttgagatggagtctcactctaatgcccaggctggagtgcagtggtatgatcttggctcaccgcaacctctgcccccctggttcaagagattctcctgcctcagcctcccaagtagctaggattacaggcgtgcaccaccatgcctagctaattttttgtttgtttgattgtttgtttgtttgttttgagatggagtctggctctgtcgcccaggctggagtgcagtggcatgatctcggctcactgcaagctccgcctcccgggttcacgccattctcctgcttcagcctccctagtagctgggactacaggcgcccgccactatgcctggctaattttttgtatttttagtagagacggggtttcactgtattagccaggatggttttgatctcctgaccttgtgatccgcccgccttggcctcccaaagtgttgggattacaggtgtgagccaccgtgcctggccttttgtatttttagtagagacgaggtttcaccatgttgcccaggctggtctcgaactcctgaggtcaggtgatccacccgcctcagcctcccaaagtgttgggattacaggcatgagccaccgtgcctggccttttgtatttttagtagagatgaggtttcaccacgttgcccaggctggtctcgaactcctgaggtcaggtgatccacccgcctcggcctcccaaagtgttgggattacaggcgtgagccaccgtgcctagccttttgtatttttagtagagacgaggtttcaccacgttgcccaggctggtctcgaactcctgacgtcaggcgatgcacccgcttcggcctcccaaagtgctgggattactcatgcctggccctcttctgcatttctgctgagtaacttctgccaggttccttaggctaagcttaagttcctccagtgacaggaatctcactccctcctaaggctacattcctcttttggacaactataggtttaagtttagtcttccttatgttaaggtaagatgtatttgcttgtatcttctcctacaagctctggttcttcccctgaaactacacagaacaagcatgatactacttctttatgaacactctttaggtatgaagaaagctattgtccagacttccctacagattcctcttttctctaagctaattctcctaagcttggttggttttttctagccagtctttttagccctttaccatcctattcacgtttctgtgaactttaacatttatgtatattaatgttaagctgtgaaacctagaatttagtggagtaatgcaaatgtggtctctgttgtaaaatagatcagaactatttattctttatttaaaacactagtcctttaatgtaggccgaaattgtgctaacatttttgacatcgacattctatcttaatgcttatctagtttactaatgaatgaaattcccagtcatctctcacaaaactgtatctcccccagctgtactcaagtacagaaaacatctattcttgataacttttatcttgttagaatagctcttttctcttctatagctacaacttgtcagtgtgtccttatcagcttatgatttaattgaggctatagaacatatacacttaaaaaaaataagctaagaactcttagaataaaacaacataatgtattgtcagttgtaaccatgaatgatgtttttcaaagtgtgtcctctggcctacattagagttacttagggcgcttgttaaatattcagtttcactccagacttaatgaattcagatttctaggagtgatgtctggaaatctgcattttaacaagctccattggacattggtgcatattaaaggttgacagctgctactctaagtactgaaggattgagcccaaagatatgatcagaattaggtggcattaataaaggaggtgatttctggggacagaagaacatgaactgttagagtaggtagaaattccaggtgtagtaaagaagaaataaattgtctgctagggaagatatttgctaggctgaattaggggcccaatagaacagcacataaaaggagttaaaagctaagggacggaaggaaaaaaaacaaagaaagaaaaaactataaaattctgaaaccagtaaagatacatgctgccatttggcagcaaggcagacctgctatagaagaagcatgatctttgtcatcaagaattcatgaaataccaggcaacaccctatgagggaatgtaaaagggtgggggtgtcagcaaagattagtttggagcattgctacacacatctcatctttagttctaggctatctaatgagaaaatctatattaaatctaagttgactgatttggatatagaccagtcggatggtagacagcttgcacagctgcttggtgctcaggaaataggctgttttcactagcatagcaaaactcagagtgctcttggcattttgaagttggtgggacaacagcaagtctctaccagacagaatagtgccacgaaaatggatggtcaaagtcctgactgcccagatggtatcaggagtagtggtcttggtcttaagtatttccatttcttaaagatttcataagtgcacagataaacaagtgtagatgacaacctattttagatgttgattgagagtcttaaggccaggcgtggtggctcacacctgtaatcccagcactttggaggtcgaggaggctgatcacttgagcccaggagtttgagaccagcctgggcaacatggtgaaaccccatctctacaaaagaatacaaaatcagccaggcatggtggcatgcacctgtgatcccagctactcgggaggctgaggcggcaggatggcttgagcctgggaaatggagattgcagtgagctgagatagtgccactgccctccaaagcctgggcaacagagtgagaccctgtctcaaaaaaaaaaaaggtttttgaaacaaaaggccctcctatataatgagtcaatgaaagttatgctcttagagtaaataattatattgtactactgaaatggtaagtcaagtagaactaagaaaatactcatgactctagttccaatttacaattttcaacagaaccataagagaagttgtaattatggaaacttaaatgatcaaatattaatttgtgtccaggcgcagtggttcacacctgtaatcccagcactttgggaggctgaaatgggtggatcacctaaggtcaggagttcaagactagcctggccaacatggtgaaactccatctctactaaaaatacaaaaattagctgggcatggtggcacctgtaatcccagctactcaggaggctgaggcaggagaattgctagaacctgggagacggaggttgcagtgagccgagattgtgccactgcactccagcctgagcaagactctgtctgaaaaaaatataataataataattatgattatatttaaaagatcaaatattaatttgtgattatattttctacaagggcatgcactatttaaaattgagcactcaaatctggtttgcacaactgcacagagaagcttgcaagactgccgaatatgtcctgacttgctactagtcttttgatagcctccttctttggcaaacatggctagtctgcatttgtactggaagccacttgggattcctctttaaacatcagtcattgttcaaaacccacttcgcacttctttctctctttatagatcatgttgcccccaaaatgaactgaacactcttatcttaatgctaatttgacagagaccacttctaatttattatcatcctgcttactcttatataaaattagtgtttgctatagttttttctccctttgaatacctcaaagttgactgacagtttttcctcaacgcagcttgcctctgataacatccagaaaaaatgaagaaaatatactgctttgtaaaatagaagagcttaacaagtacaaatttgtcacttttttcgggtgtttcgaaagagtgtaaacagtaaacattgctgtttatttcttgtgtttcagaagtaaggctatgtatttttatcgagctatttacaatttacatataagatgtaagtattttcatgaatcattttcatcagtggggtggatatacctatcatagcggatacggtcctattctgacttttagatcagaaatcactttcagttatttgtagcacacaccttaaagcctattaaagttctccccaccaaaatttgtattattataatcactggatgtcaacacctgtggctcaaacagtatccaaattttgtatattgttggaggattgctgatttaactgagagttgtagctagaaataaggtgagaaagaatatacaggtaatactaatccacctcaaactaagaagcaaaggatggtggatgggctatgttgatctagcgttgcaaaaacacttttggatgaagtgcccagaaatagccccagttcctttcactagaatcagctcgtcccaggtgaatgccggcagagcagggtgtgtgctccccaagaaagggcagtgaccgctttccaatgtctggcagttaggggcgatgagagtagttgcaattggcaagataaaggggaactttggaaaataaatatacttatgatagaggaggcaggagaaaaggtcaagggctgtacacatgtggaactgataatcatggtagcttggcttctatgaatgggtacatgttgacccttaagtgagcttagaaagcttgagaaatcagtatgcgtgaactgtttgaggcataagaaaggcaggattttaaaactttttttttaatttgtgcaaatttatgggatacatgagaaattttttacatgtatgtaatatgtagtgatcaagtcatggtattcaagggatctgtcaccccagtacaatatattcttattaagtatagtcatcctaccctgctatcaaacattgaatttattcctcctatcttactgtacgtttgtacctttagcctacttctccttagcctcccttcatccccagtcaccctccccagtctctgttgtctacttttccactctctacctccatgtgttcaaattttttacctcctacatatacgtgagaacatctgatttttgtatttttgtgtttggcttatttcatgtaagataatgatctccacttccatccatgtagctgcaaatgacataatttcattgtttttatggatgaattgtattccattgtgtagaagcaggcagaattgactctgatagtagtctagctggaagagaggctatagctacaaagaatcttgacttaccaaaacactagtaacatgtctgtgaaactgctgtagtctaactcatttactactatgttaatttggagcgtgaagttcatcagtggaatgggtactataatttgcaaagttcaagtgacaattctggtagataaagttttaaggagcagatggtcacaactgtcagtctcagaagtaatttggtaagtaaaatagtcatttatttggaagttttttggtaacctaattgtgatctaattgtcaccagttgggagtctaattccattttcatcactcatctgcagaaaggtgagagaaataagctattaattaatagccaatatttacgagctcttactatccaccataaagtatgctaagtgctttatgtgcattatacttaattatagtaactttctgaggtagttactattattatttccagctagttagtggaagaaccaggatttgaatccaggcaaactgactgcagagccctcacttttaacactacacataaaactgagtttatttaacagaaaacactgtcctttaacctgagattgtgtctacctttcaatactaaaatgtactttttatatgaaatggtggtgatagacgatgtcaggtttgattttcttttttttttttttttaagaaatctttaccttgcaaaactaaaactaaaacaacccaatgacagcactgctctccagtttaaagaaaacaaatgttcttttgctagttgtgaaatctaaatttgagaaccactgactagaaaagtgggactcttagtaatttttaaagttctttagagatttttcacctgatttattttctgatttcaacctccttgttttcattaaccttttccttaagtccacctcagccactcattcttcgattatacacaagactttgtttgccattaccagcaaccacaccactttggggatctcagatgtaagcatcttgctctcgcgctgcctcccatttttccttgcttactcctagcatttctcctgttaccaactccagcaacttggaccccactggaacctccagtataatttattctatcagttcccaatctttttgttctctctctcctctttccccagcttaacctccatggtctatcacatatatcctctttgtatacacctttagcagccttgctcctcatcttctgttgtcaaatccacaagtgtttctcagctacctgcctactctgtgccagtattctcgctgttaagcatggcttaagaaaaacacaaaaccacagtgtctgatctcactttaaatttatgaaccaaatctcaagtgagccctcagtatttcttggaacagatattcctagtattccttctgtatttccctagtccaatccatttattctcctattctctgagatgactagttcttcttctctatttggctcaacccccaagcaccacctcttccatctttaccagcagctgatgacctggaatctttacttcacggaggaaatagaggcaaacagaagagaacttcttcatcttcttcatcttcccaccacaagatgtatgattggttgaatgagagaaagactgtgatgtcctagaacttcagttgctcctatatccaatgtaattagcaacttaaattccaaaaccatatataaaaatcgatttttggccatttgagattatactctttactaccactttcctttctcttattataaccaagagttgttactatgtttgtgcctcatccaaataaaaagtaggtattttttagaaaatgattaacgggagcaattagtaaaacaagcagtaaaatacccggatacaggaaattgagccaggcttgctggtatgtgcttgtcccagctactcgggaggctgagttggaaggatcgcttgagcccaggagttccaggttatagtgagctgtgtcacaccactgaactctggcctgagtgacagagtgaaaccctgtctctaaaaaagtacttgacataggatattgagagaagaaatgctttggaactatgtttgattatacccttagcccaccttagttcttacttaagtaagttatagatgaaggagaaaagatgggaatcactttgaagattaaggcctcaaactttgtggaaaatggaggaaaaaatgttgaaaacagtcatgtgatagtttttaccttacacttttgatgggaaaattagataatagaattgagctatacgtatgttgactgcacattacattaatttaatcctgttatttacctcatattgctaacctttaaaattaagatttgaaaaaaaagagatgggtaaaaccaaaaaggtcaaaatttgtatgccagcttagatgaaatttgtatttatagaactgaataagaatctacaccttacctaatactgtgaattgcttatgtaaatacaacaaaggatggtccctcgatgacctgaatctcatatgctgagttcacttagtaacagcgtccgtctgctcagacacattttcccaactccccatgtgctttccaaacctttaccatgtttcccagtatcctctcttcatccctcattttgttgatgacctagttcctgcttcacatagtcaacagaacccaacaggaataacctcagctttcttcctccttgtccctttatttaactggtctcagaaggagaggtgtctttacaagctctccctctccattcctcctctgttgccaaagtttctgaaagtgtggtctccatatctgcttatgctacttagttttcttctaagtgaaaggtagggactcaaccccaaatgctctgaccctgttcgaagaccctgtggcctagagcggcatgtatttcctgatttctaaacctagtgccctttttccaggcctcatcctctatcactgcagcatttatctctgttgtcacattcttctgcttaaaacttttcacagcttttcacgtacccagggcaggcattcaaaaatattgaagcagtagttttgatgtcttttctgagctttcaccagtatttttaataggcactactgcctaaatgtcaaatgccttatagccaaaaacaagtaatgatttcctgtaatctccaaactgattcctcttcctcttgctatgtcttggtatccctgaggttaccatcattttatccatgtacccatgctagatgcctcaaggtcatccttgactcctcttccttctctggtttccatttggtttctaagctttgatgagtatctcccgcatcttcttttctttttctactatttcctatgactcttgcctctttctgtttattgtcttttgtctggattatttcagtaatatgttcaggagtttctaatttggattccatggatggacctcaaaggattaaagaactctctcaaatttgtatgcaaattttttgtgcatgtgcattttcctggggaggtccattagactgttctgtgggaaagagaggaatagaatgagagacaatgacaatttaaatcaggtccactgatttctcgttctatacctggcctttgttatttaggtcactaacctaaggcacttatctctgaggagtgaggtggcatgtaagatattaagaataaaacagcagcattagtcagtccagctgggcagtcagtccagcagccagagatcagaggctcctcaatatcagatccaggctttaatatcctagagaagctcaggagaaagctggggcatcagcaggagcagagggtgtcctcccgaggcccctggacccatttgttcctgtgcttccaaaggacttagagggatatgaaaacttaactggcaagaatccagagtgagttggtatccccagaaaaaggttcagaacattcccccagctagcctcccctcctttgcctgtttggtctctcgttctttctccactctgccaacacagttagcttttaaatacatatctcctggtgtgccttccgtgattgtcacttacacctaagggtgattagactaatcacccaaaaatgtggggttttaatcacctatgaaacaagttaaaaaatcatggtcatggtttcaaggcctgccagttaggagcctgccagcctcgtcgccaggcactgccctctcctcacttccagggctctggctacagcaggttactactggctgtttcgagagaacagtgtctgtgtccatatccctatgcctttgatcatgctagtctctctctttggggtggcatttcctctccattgcctgtgaacctcctactcattcttccaggcccacaatggatgttagctcttcacctgagtccattcttaattttctgccatcactctggcagaatcagtatctcttggctagagtccaaaaacatttcatacatatctctgataatgtcatattatattgtagatagcctatttttatttctgtctttcctactaagccagaaatgccctacagctagggactgtctttttcatgtttgtatccctaacagctacctttgcatctagtctaaacatgagcttagtacacttttgttgaatggaattagttataaagagtttttatgactcatttaaaattagagaccaatgcttacttaataagtcagaataggctgtaataataatagtaataataaagtcccatttccactgcttattcaagtaacagcttcctttgtggaagtacattttgaaagacttcacatgtcagtgtatatttttgatgtgctcatttgagatcctaaaagaattatagttctaaagcagactagagcttctattacattcctgttgaagttatattaaatatattctatcgtttcacatatctgtattatatataataagttgcatgggtaaacattttatctcttttaaacttcatggtaataatttgtgaattgtttattttataatatctgagtaaatttagttcaaaacacattaatttgagcattttctgtgtacagaagcatagttgcaaagttaagattcttgtgtttatgttgttttgttaaattcggaaagtctcagtcttgcaaatgtattttttttttaagtatttaaattagctcagctatgagaataagcacggtccataaattaagagcttcaaataattttttaaaatccttcatattctttgagttttgtaggaaaagaatcaacagtttacttattcagcctttcctgaagtccatagtaggtgctgggcatcatgctgggtgaatgagatagtacttgcatttgaatagtttacagtcttatagcgaagaagccatgtaaacagagaattgcaatataaaccttggaggagaggaaggaagactactttgagaaccgagattaggttgagaatggatgagtctgctgatcaatttatagataaagaagcagagaggtgaagtctttttttttttttttttttgatatgtgaaataggaacctaggttatctctaagaattcatagcagggggtagctcttgagaagaacagtgaagatctggataattaataaggagaattagagatgagctaacaaagacaagtaaagagtggcatgagaaagcagtgagcatagaactgaaactggatagcatgaaattctggaggtatcagtcagtagcacagtggtataattttctccagctgtgctatggagaaattatacacattgtggccaatgtgtagtgaataaagccatattgtattcagggactatggggtggttataacagaaatttacaaagaataaatagttaaaagtccttcaaagaaagcatggcttactagggaaggcagtatggttaagaggaagttgataaacttggagaaaatgtagaagtcaagaagttggagatcagaagggctggtgctttgtaggaactcagaaaatcttcattttcttctttctggatgtcctctccctatgaatgtttcaccaccacaacctgcctcagctacagtttatacatatgaatagtttcaaatcatgatggtaacagttggctcagagggcaagattaggagccagacttcaacgtgctgctaatccagcgtgtccctgtaacttagatgctggtagtgcttggtggtattggcctctaggagaagctcaaggcttctcctgttatctccctaccactcatacttggagggtgagtcaaaggccaaaaagcattttattgggcagtggttcttagggaagggatttactctgtgatgcagagggttaagactgtaagccatcaagtgtttcccctccctctccatgttcaaccaaaggcacagttcttattactttcaaggatttaaaaaggagtcttttctcagcataaaggaggaagtgaagaccaattttgacagcccaaagggtcttcctcctcagaatctaaaatttctaatagagttgtttgcatcttgtgattttacttgagtcatcaaatgtattgtactttttttcttaaagatatacttcttaatgctttcatttcagataaggacaaaccattttccatggcgacacactatttatattgcattttcagaaatttccctttttacccatacttaggagtgtgacactgaaacctgataatctattatttcacagagtgcttttttgggtgtaatataaagatattatataattttaataacctttgaggtacaagtggtttttggttacatggatgaattatatagtagtgaagtctgagattttagtgcaggacccattgtccaagtagtgtaaactgtacccaatattagttttttattcctcactcccctctcactttccccacttcttaattttctgccatcacaatgtgttgcccaggctggtttcatgccctcactttccccacttctgagtttccaaagtctattactctgtacacctttgtgtacccataacttacctccctcttgtaagtgaaaacatatggtatttgattttccattcttgagttacttcacttagaaaaatggcctccagctccatccatgttgtagcaaaagatgtgacttcgttctttgttatggctgaatagtattccatggggtgtgtgtgtgtgtgtgtgtgtgtgtgtgtgtgtgtgtgtatacacatatatgatatataataattatatataatttatcgttatatgtaaaacaaagcaaattttttatttttatagagacagggtcacaaagtattgcccaggctggtttcatgctcctgggctcaagtgagccaccacacccagccaaaaataagtaatatttcccagttagacattttcagagtaaaaagtatttgttcaaaatcatagcatgaatggactcttccagagacctttaactggcagcatttccccctcaaactttagtacagttataggaattgtttctggatttttggctgtatattcttgttcatggctcatggacattaacatatgtgaatggcatcactgtgtttttcctaaagtgcatacgaagaagaaagaacactttcctttagagtcttacttagattctagttagctgatataagactgttttcttttccttttcaggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggagggtaatgtgaacataagtgtgatttagtaaaagtttatcactcgctatacgatgaatgagacccagagttatggagacaaacttgttgctttgatttatattttgaagcaacttacaggtaaatttacctagtacctaggttatatatggcactgcaccagggactgtggaagatttacgtgatgagcagatgttgttgcccacatattcctataaacaaaggtaggtgattgtgtaagccagaggttttgcaaaaataggtcatgaatatattttcaggtgacacttttattccatattgcttccagagacttgtgctcatttatcctttggaagaaaaggggaaattaaatccataaatagacttatgaaatcgtattatgtaaggttcatatgcaaaaagctatcttacttaacactgagtcttgctcagttatagagtgacaggattgagttgtcagagctcaaaggaaagcttgatttgcgtctcagaaatgaaattatttaaaaatcaagctagaatttactaattctgatagttttacatgtcaacttgactaggacataaagtgcctaaatatttggtaaaacatttcggttgtgtctgtgaggatgtttctggatgaaattagcgtttgagttgatagactgaataaagcagattgccctccctaatgtgggcaggccccattcaatcagtttaaggcctgaacagaacaaaaaggcttactttcctgcaagtaagagggaatttcgacttgcctggttaccctgagttgggacattggtttggatgcacaccgaaacatcagctcttcctggcttggaggcctttgggctggaactaaataatgcgtattagctctcctgggtcaccaggttgctgacagcagatcttgggacttgtcagcctctgaaattgtagatttatcccaaggaattggctaaaacgattatggaggctgacatatatatgtgggtgtatatgcatacatacatattcatagagatttatcataaggaaaacacacacacacacacacacatacacgaacattctattggttctgtttgtctgttctgattaattatcctaatactaacatatttttttcattgacagtttaagaacaatgccatgagatttctggttctagcaatgcagtagactaggtaaccagaaaaccttccttctataaacaccttcaaatgctaggtatacactgtaccccttaaatatgcacagttatgtgccaattaaacacaaaataaaacttttaaaagttctgggtaaaacataactgaaatcattttaaatgcataattgagctcttcagaaagaaaactggatctccaggaaattagagtcgtgagatacgggctgcagcttttggtttcataatgtatgggtttgggttttagtacccactagggaacagaacatgagtccttgaatccatttacagtgtggactaggaactggtaccttcaaaggggttgtgtctatgaaaagagtggactagaaaatatctgctgccaccacagggaaattaacaaaaaatatttaactgcctgggttctggaatggaagctgggaaatctcctatgggaattcttcttcttttttttttttttttgagatggagttttgctcttgttgcccatggtggagtgcaatggcgtgatctcggctcaccacaacctccgcctcccaggttcaagcaattctcctgcctcagcctccccagtagctgggattacaggcatgcaccaccacgcccagctaattttgtatttttactagagatggagtttctccatgttggtcaggctggtctcgagctcccagcctcaggtgatctgcccgccttggcctcccaaagtgctgagattataggcgtgacccaccatgcccggcctcccatgggaattgtaaaccatggatccttgttcatgctggtttagaatttgaatgaatgtatgctacctatgtggcttgaaacccgaagctgagaaattagttaaaaaaattattcaggtgcagtggctcatgcctgtagtctcagctacttggaaggctgagatggaagggtcactagaacccaggagttctaggctgcagtgagctctcattgtgccattgcactccaacctgggtgacagtgcaagaccctatgttaaggaagaaaaaaattagtcctgggctagtgatagcataagttgtcagatataagcaaaccccagggggtgctccaacaacctaggctgaaaggaatagaaaaagtagtcatgaaaatttaaaactcagcaaccaagtttaagataagacaacaaatttcagctgaagagagaagtggtaaacagaagaataaacctaaagaaatcacccagaatgtagcacagagagataaagggatggagaagatgaaagttgagatgagagagttaaaacaagaagtccagatagaatagtgtagaggcattattcaaaaagagaatgactaagaatattctagaattaataaagacataagtactcagattcaggtagcaccatgagcctatatgggataaatgaaaattaacttatttctagacttgttataggagaatgccaaagaaaaaaaatcttagtaacaaaagaaagacatggagatgacttacaaaggggtatccattatgttgatagcaaacttttccatgacagaaagagagaacaaaaaacagtagaataatatcttcagagagctaagtgaaaataactgtcaacttaaaagttaatacccagcttaattctcattcaggaatgagggtgaaataaagactttttttcttcaggcaaaggataatagaattaactagttgcagaagcttgttggaagattatgaagcaagatgtactgagactgaaggaagttgaacccagaaggaaacagtagagccaagaaacaatgatgagcaatgaaattggtgaaaatatagataaagtctgggagttctacttctagtagtggcaaattaggtcatttgagtcatgtgttccactgaagactaccagaaaagctcaacacaatatttaaacatgttttgcttgaaggtatcaaagaagaaaaatggaggcctagaacaaaggtcctcctggtatactgggtcactgttcctctcgagatattagccagttctgcaggaagctgctaaaacctaagcagcccttttgacaggctagtgggagtaatgggggcagagattagtgcccatggcccctaaggaggggacacctgatgaacataactcattttgagtcaagaccctgaagggctacaccataggagcaagggttaaccaggagtagacatactctcactgaggctgcagatcagctttgaatcatgtcagtccctaaaattagattgagggttcctaaattgctagtgcccctaggcatctggcagaattgtaaatccttcctggaagaaagtggtatcatgtaaggtcacaaattgtttctagtttgcaaatgcaatgtctggcttataatcaaaagcaactggaaacagatacacaaacaacatcaagaagaagaaaagatggttcaaacagcctctagatattggaattctcagatacagacttttgaaataattatacttaccacattcaaggggataaaagacaagacagatttttggcagagaactggaaactaaaaataaacaaatataaattctagaactgagaaaatcagtaagtaaaattaactcaagtgaatgagtttaaatagcaggttagacacatctgaagagagaattagtgtactgaaagatataagatgaaaataaccagagacaaagaatgaaaggaattaagagagagtaagagagagagagagagagagagaataccgtttaaaggtctggtgcgtgtatttaaagttccagaaaggcaagagaaagaggatgaatcaaaatcaggatttgaagagaaaatggtttagaactttctaaaactgatggaaaacattagtccataaattgcagaaatgatatgaaccctgagcaggagaaataccaaagaactctacatatataggcattattgttaaattgctgaaaaccaaaaatgagaaaaatcttaaaaggagctagagagcaaaggaaaattaccttcaaataagcaacaactagctagtagctgtcttctcaatagaaatgatggaaacaaaaagtcaatcaaaggccatttttaaagagctgaaagaaaataactgtcaacttagaattttatatccagtaaatggatgaatgatcatagaaatatataatggaatacaaggcagtaatgaaaataaatagcctacagctatatacagttgtgaatctcacaaataaattattgagcaaaagaaaccagatttcaaaaaacacatactgtgtgattccatttatagagagcttacctaaagtatagtgtttaacaacacatgcttgggtggtaaaactataaaggaaaatgaattattaccataaaaatcagattgtggttacccatggggaaaggtcagggaggagtgcttgggaggggttgtgaggaggtgctcccaggatgctagcagtattctgtttcttatgattacgtaggcgttcattttgtgacagttcattgaggcatatattcacattttgtaacttttctctatgtgtgatgtattttgcaattaaaagttttaaaaataaattttaatagcattcactgagaaaaacaataatgatatgaatatttttaaaggatagaactaaaatatggaaaaaaacgtttgggaagtagattaaattcatgtaagctccttatattattggggaagatggtagggagtttgagaccagcctggtcaacatggtgtaaccccatctctactaaaaaaatacaaaaattagttgggcttggtggcgcacagctgtaatcccagctactcaggaggctgaggcaggagaattgcttgaacccgggaggcggagattgcagtgagccaagatcgtgccactggattccagcctgggtaacaaaagtgaaactccatgtcaaaaaaaaaaaaaagaagctaataatgttagttaacattaagtcaaatgtgcatgtgaaagttgtacattgtgcccaaacttttccaaagcatagggaggagctgggaaagaaacagtggaaattcaaatactttagaaggcaagaaagaaataacaagactcaaagacaatgtgatgataataaaaaggtaattttaaaaacaatttcatttatagcagaaatcagaatgtaaagtgcctaggattcgatctagcaggaaatgtgcaagacctttaaggagaaaattctaaacatttttgaaaatctttttttaagcagctaataaatggtaagatataacatgttcatgtatgggagaactgacaatgtcataaaaatgagttctgcccatcttggtctgtaagttgagtgtatttccagtgaagcctaataggaattttttaacatttgacaacttgattctaattttttttgaggcttgaagagttatgagaattttgaagaataatgaagatttacttttatcacatatcaagacttactagaaagcaatagtaattgaaacaatgttatatattcatgcaaaaacagaccaaggaaacaatagaacacaggaaggaagagcctgctctatgacaagtgatgatacagatcagaggggagtaataggctggctgtgccttaaacggagctgagataattgactacctatttggaaaaagataaaatgcaattcctacctcacagcatacaaaattgcaagtggatttacaaaaaaacaaaaacataaaagcctactaaaatttataggaggaaaacttatttagaagaaaaataggcaaaaatgttttaagatttgaggctagggaagaattgatacagaaagtaaatccattggaagtgttaatttggctacattaatataaagaaaattctgtatgacaaattacactgaatacaaatgtctcaaactgggagaagatatttgcagtgtatataatctacaaagaattggcatcctctataataaattctctataaaaagtcttgtataataagaaaaatataaataccacaatttaaaaaaactgtcgaaggatttaacacgtagttctcagagaaagaacacaattgaagaaaagcaaatgaaaagatattcaggaaaatgtataataaaagagggattatttcttaaacaacctggcaaaatttacaacagctggtaaaaccaagagtttgtggggttatggagaaacaaggtctcatatacattgctagttggagtataaactagaagaatataccaagtgggtagtatcttgcaaataaatttgacatcttacaaaaatgaaaatgcacaaaccccatgagttctacttcaagaccactacctatgataaacaacatgacatgtaccaggatgttgattgtcatgctatttgtaatagaggaaaaagaaacatcattactcttccttagtaggaaatggaatagcatacagatattaaaatgaatatgctgagcacagtggcccacgcctgtaatcccagcacttcaggatgccaaggcagaggatcatttgagcccaggagttgaagaccatcatgggcaacatagtgagaccccacctctacaaaaattaaaaattagccaggcatggtggcacattcctgtggtcccagccacttaggaggctgaggtgggatggtcacttgtgccggggaggtcaaggctgcagtgagctgtgatagtgccactgcactcccgcttgggcaacagaatgagaccctatctcaaaaaaataaaatgaataatagatttacatagatcgacatgaataacactcagaaatataacatctcgtcttcaaaaaaaaaaacctagtaagctgtactgaattaatctatcctaccatttaaaatttttgttgagggtaaaataatattaaatattccctttatagcaatcctcttagtgctttaagtctgcttgttgggtccttaattgtttcaattttatacaaggtcgtttcctttcctgctttccagcatttcattaagttcttgttcaggtctccagctagatcagtctcattggttctagcaggtgtgggtcttggtgggttggtgcaagtccattcactatttcaactcttcagaaagtcccggaaccagtcagttttgcagttcattcctaatactaagattgtttctgcttcacttatctttttaacttacctcagtgtaccaagaaaaacagtcatcaccatatactatctaggttgaataaactccgcttaaaaattattttagattattttccaaataatttacaaaatacaagaataaagagataaaaaactattaaaaattaaataagaacttaaatatataaataaaatttttatgccatgtttccctggtcttgaggtgttttggattttggtttttggaatatttgcatatacattaagatatcttggcgttgggactctggtctaaacatgaaatccatttatgttttgtatataccttgtacacacagcctgaaggtaattctgtacaatattttaaataattttgttactgaaacaaagtctgtgtacattgaaccatcagaaagctaaggcatcactatctcagccactagatgtggatggtctgtggttggttggcatcaccattgtttctgagtgtaaatttatatgcctgataaataatcgttttcatacatgtattgagacacaagtacttaacagtaaaaaatatgacacaccattaatacagtgaaaaaatagtgagtttagggtaactaagcagcacaatggcatcaccagaatacctggataagctgttaaacaacagcaacaccaaacagcaacagtttcagtcaccacctacgatgttgtggggggcttttgttttggtttggttttttgagatggggtctcactccatcgcctaggctggcatgcagtggcaccatcatggctcaccgcagcctcaaactcctgggctcaagccgtcctcctacctcagcctcccgagtagctgggactacaggtgtgcaccaccatacctggctaattttaaaaatctttttgtagagacaaggtctccctaggttgcccaggctggtctcaaactcctgggctcaagcgatcctcctgcctgagcctcccaaagtgctgaaatgacaggtgtgagctaccatgcccagctgatgttgtgttttgattaaaagattatcatacagtaaccccctgtgtgtggtgcacctttcagattttggaacattttggattttgaatttttggattagggatactcaacctgtataccccaaatgggcaggagcctctgaatgcagtaactgttcatcagctgtcctgcatgaacttacaaatactgattctaagtttcaaatacatctttgttggcttctaaattattattacttctggttcttcttgcacttacagcatcaaaacataatgctttaagaatttttttgagatctttggctcctaattttgttgaagagaggatgaccattatatgttccacagttgcaaaacatttttatttttagatttgtagatacctttcagaatgatcaattctgttttttatggtcaatccaattttttaatgtctacttcatctatttcttctggctatctctctgtaatacctgccttcagcatctgtctacttttaaactatatcaagaaaatttggtgcacaaatgaaataaaagatgaaagaatactgtcatgtgtccttttagcaaaatgggatggcctcatttcttgtcacaagatattccacaaagaagactttctattgaataagtaactgaatgaaaatgctttgtccttagattaaaagtatattattcactcattgattcttgagtttgagaaaatgtatgtagggcatcatcatctgaagacacatagactgagattttacttataatcatcaatttcagcatctttattagagtcctaagtgctcctatcttattctttgtgttcaacttctgactcatctaataattctaaaacagtttcctcagattttcttcgtcattctggctagagaacttacaaatgttaatgcttaatcgtattcaataaaatgtagaatgaggtcacaaaagatgttagctccagacttcttttatgccttcttgaaagataacacatatcttgcacaacacagtaagaaaactgaagagtgatgtcatagtgatacttgtttcactgtttctaagtaatttagtcattttttattatactttaagttctgggatacatgtgcagaacttgcaggtttgttacataggtatacacatgccatggtgactggctgcacccatcaacccgtcatctacattaggtatttctcctaatgctatccctcccctagcccccccacccactgacaggccccagtgtatgatgttcccctccctgtgaccatgtgttctcattgttcatttcccacttatgagtgagaacatgtggtgtttggttttctggtcctgtgttggtttgctgagaatgatggtttccagcttcatccatgtccctgccaaggacatgaactcatctgtttttatggctgcatggtattccatgtgccacgttttctttatctagtctatcgttgatgggcatttgggttggttccaagtctttgctattgtgaacagtgcctcaataaacatgtgtgcatgtgtctttatagtcgaatgattgtaatgggattgctgggtcaaatggtatttctggttctggatccttcaggaatcaccacactgttgaaacagcatggtactgttaccaaaacagatacatagaccaaaggaacagaacagaggcctcagaaataatgccacacatctacaaccatctgatctttgacaaacctgacaaaaacaagcaatggggaaaggattccctatttaataaatggtgttgggaaaactggctagccatatgcagaaaattatacaaaaattaactcaagatggtttaaagatttaaatgtaagacctaaaaccgtaaaaatcctaaaaaaaaccgtaggcaatacctttcaggacataggcatgggcaaagacttcattcttctattttcttattttaatcctttttaagcatagttgagaataattgatgagtaatgatgtaatttctagtgtgatgaaatagcataatgtgtcttagattcataaaaagatctagtagatccaaatggcaattgtaagatagaattttattctatttttttaaatattgggttttttgttttgtttgtttgctctttggaaaaaggaaaaaagtcatgagatatcaatttttataaatagtactacttaaaacagaaactcagaaactgagattgggtctaacggaccctaatgagatactgaggattaaacactaggcagaagtgagttaaaatgccatatggagaagcattttataacatctcagttgtgatagttaaccacatggctgcataggtaactttggtgctgtttttaaagttgcaagcaatttaaatattaaactactgatgataaaattgagttagcaaagaatttccagttcgatattaattatagccagccttttcagttatacctttctcacatccagaaatggcttgatgtactcagctaatgacctcatgcaggatatatatgtgtgttacataataaagaaaaacatcacttctgtaattttggacagtccacactgacggagatgaacacttgcatataggtcaaactagttaaatatagaacagccgcttttgaaagctgttgccagggctcaacagcgtcagctctgtttctatggagaaagactttgcagatgttaaaaacagagctagaagccaatgaatggaagaggattgtgctgtggaaatttaatttttttgataaagggtttattgatgaatcagctatattagtctgtgaacgttaatcttgacatcttctttacccaattcccaatttcttggaataagatcttgcttttatttaagtaacacacaatgtaaaatttgatgttattgtactgactaggtggggtaagggacctgatgacaggtaacaagattagtaaggttctgaaaaggtcagaattgtactgaattatgtttagaacagattgcctccgtgatcatttaatcaaacagtgttcgtattgtctttgtccttgtccacatacgtgatttttgaggttgggctgagaaggaaatcatgattccatcaacaacataaggcacattgacagtaaaactcatatattatagcagctttttgtttcatgctgtatagggcagacaaccttgaagaaaaaaaaaactttaaaaaataatgtaaaatttcacagtttttcagtcacaaacagaagtatccttgttgtcactgaagatgacaagaattaatatcctgctgtatagaagtactttggcaaagttaaggttgtagttccaattcctcatttccaattttttctccagatggaaagatgaacagtttttggtattgaatttttttttaggaagcaagttatttatcattagatatctattcagtaaatgcaatgatacagaaaaatgaagtttttttccctcagatttgaaattaggttttaaaatatggagggagaacaatttgtaagtaatgttcaggaacaaaaataaaacctaatgaaactttagaaactttgatggacatctgtcatcctacatacaattgcattaaagaatagaatttattattattttatctggtttattatgctgtaaaatgaatttttctctttttgtatgtagttttatgaaatttcatacatgtatagattcatggaaccactgtaaaaatcaggatgtagaacatttgcatcacccccaaaaactccttcatgcagtcccttactggtcaccctttctttttagtaaccctggtaactaccaatgtgttctccatccctgtagttttatcttttcaagaatgtcatataaatggcgtcatacactatgtaacctttggggactggctgtcttcagcataatgcctttgagattcatccaagttgttgcatgtgtcaaacatccctttttattgttgaatagtatttaattgtgtgggtgtactatcatttgtttatctcttgacccactgaaggccaattgggttgttttctagtttggggcaattatgagcagagctgctataaaccaagtagtggaatttttaggtcatatagcattttatctattttttatttaaaaatatatattcagggtttgtttttgacccagttgaatttccttcaggtcatttttggaactctttcttcctatgtctgatgtaacatttcatctttcatctttgtcatttttttattcccccttttcttcagattactataggtatattctggtattgtagcccagaatctgtcctgcttttatattcctccagcttaattatatgatccatcttcttacggtatctacggcttgctacaagactattctttactatttgcagaagacgttcagatgtatcttgctatccttttttattcagttgtgtatatcttgttctctatttggaggcctttccaaatagatgtcttgttaactctttaatcttatcatgctagaaacaaacaaacaaacaaaaaaaattcccttgtatcttttcccttctgcagcttccttatcatactacagggtaatttcttttcttcactgtcagtcttccaccctacatgcaagcaataatcaaatctagcatttgctgtttggtcatcaccactcctgtcaccaaaattctcattctgtttagattctgcttgcctcatttatgtaccattatttgtttctcactgaccttccaagtgcatactccttttcatcctaaagccaagaataaaatcattttatataaagagcattctactttgcagttcatttactgatgtcctctgtttcagtaggaaggcctaattctagatttcagtctgtcatgatagtactataacttctgcttctcacattaggtaaattttattatcccttttataggaccttgactgcctctgggccttctgttcagttgaacccacatgcttctaacttcttagctattagaccctctctttccccttttatatgtctttgttttggtacagcttctcatacccaaaagcaggtatacctgttagtaaggaggatacaagttgtatttgtaggtggtatgattgtctacctaggaaattcaaaagagtcagatttttttaaaaacttagatattataaataagagtaaagtagccatatataaaataaatacataaaaatatatttccttcatacttctatactgtttctgaaatataatagaaaaatcccatcacaattgccaccaaaaaacatagctaggaatctttatgaaggaatgaaggaatttaaacaacaaaaactataaaactttattgggaagctgggcccaatggctcacgcctgtaatcctagcactttgggaagccaaggtgggaggatcacttaagtctaggagttcaagaccagcctgggcaacatagtgagaccttatctctaaaaataaaaataaaaataaattttaaaactttactgagagacgtaaaagtgttgaataattggagaggcattattcttctaaaaaaccaaatatgctatacagattttagtatttcctaaacttagatatttaacctaatttcagtcagagcttgggtttttgtctgttctttatttttttatttttaattggtggaggttattccccctcataagaatgattctgatgttcatttggaaatacacatggttggaaatagccaagatagttatgaaaaagaagaatgtatagaggagaagagcttcttcaatgtactactgtaaagttatggagataaaaacatgaatgaatccattgagcagagtagacaggctggtaataacctagcatacatcaaagtccaaaccttggtatgatggcagctcagtcaacgaagaaaggagggataatttagggaacaatgctgggtcggttatttgaagaagaattagttggcttctcactttacttgtaccatacacaaaaataaaacaccagataaagaattatatgtaaagcaaaaatttaagaaaagaaaatatgtgaccatcagtgtctgtaatggggaacaattttaaggataaaactaatgaaaatatcataaaaataaaaattgtgctggctgtttagtagaaacagaaaacgccttccacttaccgaaaatataccataaataggctgggcacagtggctctcgcctgtaatctcagcactttgggaggccgaggtgggcaaatacctgaggtctggagtttgagaccagcctggccaacgtggtgaaaccctgtctctactaaaaatacaaaattagccagacttgatggtgcacgtctgtaatcccagatgtgagaggctgaggcacgagaatcgcttgaacctgggaggcggaggttgcatgagcagagatcataccactgcactccagcctgaacgacagagcgaaagtccatctcaaaaaaatatatatacttatatatatgcacacatgccataaagaaaagacaactggcaaactagaataaagtagttacaagtataataatggccctaatgtataaatcattttttaatcaataggaaaagctcttgaatttcaacagaaaagggtatagaagacatatcaaatactaataaaattaccaatggtaaaaacatgattttttaacagcaccagccccttcagtaattagataaatgtgatttaaaaacaacagaaagatactattgtccatctatcaaattgagaattacttttaaagtgtttctaatattcattacttgtgggaatataccaagataggcactatcaggtactgtgctgggattatagattgataaaacctttctggaaaagtgtttctactttttcaagtgttcctatttcaagggccttaaaatacttaacacaccttttaacctaacaatttgcctttagcaagtattcatctatattgtcaagcgtttaagtataaaagtgttcattgtaggctgggtacagtggctcacatttgtaatcgcagcactttgggaggttgaggcaggaggatcacttgagtcctggagttcaagaccagcctgagcaacatggcaaaaccccatctctacaaaaaaaaataaaatattttccaggcgtggtagcacgcatctgtagtcccagccactcgggaggctgaggtgggggattgcttgagcccaggagtttgaggctgcagtgagctttgatcgcaccactgcactccagcctgggcaacagagtgagatcctgtctctacaaagaatgaaaaaagaaaatgtttattgcagcaacatatataatactaaaaacttagaaataattaaatatctaacagtaaggaatgaatatggagtaggagagttaaactgtgaaaccattcatatgattaaatattatagagctattaaaaatcatatcatcggccaggcgcggtggctcactcctgtaatcccagcactttgggagggcaaggcaggcggatcacaaggtcaggagatcgagaccatcctggctaacacggtgaaacccatctctactaaaaaaaaaatacaaaaaaaaaattagccgggcatggtggtgggcgcctgtagtcccagctactcgggagtctgaggcaggagaatggcgtgaacccgggaggcggagcttgcagtgagccaagatcacgccactgcactccagcctgggcaacagagtgagactccgtctcaaaaaaaaaaaaaaaatatatatatatatatatattgtatagggatgggaaagggtttaaaataatacctgtactgaaaaacaggatgcaaggtattacatagctccattttggctgagtttgagatgattgtgatttctttattttttgctattttcccacattttttataattatatattttgcaattggaagcaaaaataaccattgaaaatcgttttcaaagaataatattcaagagaatacaaggtgcagtaagttcttaatatttagttaaaatatagaaatctgtggaccattaacagcacttatctttaggtaatgtaatgatgttttatagatgggtctttattgatgggatgtcactatgttgcccaggctggtcttgaactcctggcctgaagcagtcttcccacctctgctttccaagtagctgggattacaggcacaagccatggcaaatgtagtatattttaatttatgtttttagtgatggaatctcactgtgttgcccaggctggactccagctcctgggctcaaggattcctccagcctcagcctccagagtagctgggactataggcacgtaccactctgcccagctttatttttacactttatttgttttacaacttttgctctgttaacaaatctactactcctttaaaaagttaaaaaacattctcttattaaaacaaagattaggctgggcatggtggctcacgcctgtaatcccagcactttgggaggctgcgctgagtgaatcacctgaggtcaggagttcgagaccagcctggcaaacatggtgaaaccccgtctctactaaaaatacaaaaattagccaggagtggtagcacatgcctacaatcccagctactcaggaagctgagacaggagaatcacttgaacccgggaggcagaggttgcagtgagctaagattgcgtcattgcactccagcctgggcagcagagcaagacttcatctcaaacaaacaaacaaacaaaacaacgattatatccttatcagagatttaatggatactaaccatatttaatcctcagtctcattatgctcatttaatttttattatccgtatgttgtcatatttaggttatgttcattttttaccagttttgttaatccctagtattttttgtttttgagacggagtctcactctgtcgcccaggctggagtgcagtggtgcagtctcggctcactgcaacctctgcctcctgggttcaggtgattttcctgcctcagcctccagagtagctgggattacaggcacctgccaccacacccagctaatttttgtatttttagtagagatagggtttcaccatgttggccaggctggtctcgaactcctgacctaagttgatccatcctcctctgcctcccaaagtgctgggattacaggcaggagccaccgcacccggccgtgttttttgtttataaaagaaaaaatttccagagtgcactttactccctgataggagactaaattacttaaatataaattttagaaggtacgtgttaaattaacctaatgaattagtagcattcagaagtgtttgtatctgttaaagattcaaaatatacaaactaatttcttttaatggtgattctatttctagtaaactaaggcagaaatcattatgcagaagaaacagcaccctgttaaccatgttctttttataaaccgtctctgttctcactttattgttaggaaggcgtaatctgttttcatgtaatataagtacatgtgagtcatgttgagtttcttcactcatttgtccaattcccagtcaacctgtaggtggagttaacctttagttacataatataacgaaacaaacattaaacctactgcttctgggacagtcttctcaccaaaactcagggaaaatgggagggtgttgccactgactgacttaatgaaagtatctgacaaatgtaaggtctttcaaatagtgagataagaaatgtatataaattatttgatcgactacttactttctatctatacacacacactatcagtatataatgtgtattttcattttatagctattaaatatgaggttctagaatgagttttcagtttgcagaattctgagaatctagttccaacacctttgagaggacaacaaccacaattgcacttgccatatttattagtcaaaatgaagcgaagtcaatctgttgaaagctttgttttgtttttctgattagtttgtttaataagacattcaaattatgatctttaatataatttcttcccctaatagcttggtgctaacagtggtttgcacatcatcatctttgatgaaattgatgccatctgcaagcagagagggagcatggctggtagcacgggagttcatgacactgttgtcaaccagttgctgtccaaaattgatggcgtggagcagctaaacaacatcctagtcattggtatgtttactttttaaaaaagtactattcattcaaaaacgttagccataagttctgaattaagatgtgtgtaggttgtgattaaactgttttgccagtgtttccaaattagaatccagtgatattgaagaatctattgtaatgcctaggcttaataggaaaaataaaagatggatttcagtcacttgtaggtttaagcttatagctcacccacaggtgaaaaagatgtaggttgaagcttatagctcacccaaaaatgaaaaatacacatgaaacaatggaatgcagtggttttcaaactgggtcttgcaggccttcgggggtcctcagaggtgctttcagggtcagtgagggccagggagtgcgtttcagatcctacatcactattataacttcctcttttagctgttttatgtactgaggtgcttctgaagatgacttctgggggaaaaaaaaaaaaaacaccctgctgttttatgaagtctgaaaaccactggcctgtaaaaaagagaaggaactttggagtcagagagatcgtgtcacattgcccctctgtcactttgacagattatttaccctttgaatcttaaattttctttttaaatactggaagttttcataacatttatattccattggcttatacagtagtgaaatagtaaagcaaagtctccttagcttgttagggaaattactattcttacatatactaaaaggacatttgattttatttttgaactctgatcatttgttgttttgttttaacatctgtgttcaggaatgaccaatagaccagatctgatagatgaggctcttcttagacctggaagactggaagttaaaatggagataggtaaggagatctgtcactgattgggtgtgtggtggggggagtggaggcatttagagttcattaacaggaacaatgtcatatggtgtagtattttttagaaaaggtttatatcatgagaagtagatgtttacatgcttgagtacctataaggaaaacattaggatcataataatctcctctaggctgggcgcagtggctcacacctgtaatcccagcactttgggaggctgaggcaggtggatcacttgaggccagttgttcgagaccagcctggccaagatggtgaaaccccttctctactaaaaatacaaaaaacttagccgagtgtggtggtgtgcacctgtaattccagctactcggaaggctgagataggagaatcgcctgaatccaggaggcagaggttgcagtgagctgagatcgtaccactgcactccagcctgggaaacagagcgagactctgtctcaaaataatagtaataataataatgataatctcctctgatggtgctttcgagactaggaaaatgcctattttatttttaatttcatcaggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggtcaggaaaatcagctaaacagattataaacattatgccagtattctttctctttcctttcaagcatatcaaggggtagggaaatgctgacttttggtggagaagagatggtaaaaggaataagaattaattgtcaactgctaaatcttcagagtagcaggaaggaagataatgtttgcatctgccctgtagtaaccactgactcatctaccttaggtcatcaccatctgacacagacacgtaaagtgaaaattttgaagaagtgtttttaaatctttgtattgtattaaaagttgtaatatggccaggcatggtggctcatgcctgtaatcccagcactttgggaggctgaggcgggcggatcacaaggtcaggagatcgagaccatcctggctaacacggtgaaaccccgtctccactaaaaatacaaaaaattagccgggcatggtggcgggcacctgtagtcccggctactcgggaggctgaggcaagagaatggtgtgaacccaggaggcagagcttgaagtgagctgagattgcgccactgcactccagcctgggtgacagagcgagattccgtctccaaaaaaaaaaaaaaagttgtaatatgtcagaggaagtgggagtttccacgtactagaattttgggggctgctttattcagcaaatatattgaatagttgatgtgttcaagctattgggctggagacataaagataattgtgaactcttccctcaaggagttcagagtcaggaaaatggacatattttcaaattagtacaataatattgtagttaccatggtagaaatacgtactaggatacttttattttgataaagtgctcttgatcttccatctcttctctcctttaggttttagttaccacctgtagacagatttactgaacatatctgtctcctactttcagatttgtactaaataccctcacctagatgttttatcaggtctcagatttaatattgcaaaaccaaatttattgtcttttttactactttcctttctgctcgcatttccctgtttatcccaatttcccaggcttaaaacatcaggattatctttgattcctggcactctactgtgccctaggtcaagtcacttgccaaattttttcagttctgtcttggcagtgccttttagttctcactgccactacccaccttctctttgattaaccttcctgtatcatatcattcaaccattcagacactttcagtgattccccatcatttacaaaacaaagtacaggcttcttttgggtcttttgggtcctctagatctgaccctaactggcctttccaaatgtgctcctgattattctccacatacttcagccaaacttaaataatcaccggtcatcagacattaatttatttttcaacatctctgctttggttttgttttttttgcatcactgaggatcttcatcctctacgtttacctgtcttttcaaaacctggctcatatgctaccactgtcctcacaccttttcacattttccctttcaagaatgttatacccgtttccttcttgaaatagtaatgtatcatttatggtactgtcagttgactttggttcacagtagatttattcggcatctactgcatgctagaccctgtgctaggagttaataccccgactgcaaagaagtaaagtacctaccattaagctgccctcagtctaaccctccacgtgcagtaacagaaagtacatgcaaggcaagagagtgaactcgtgtcagatatggtcaacttgtggggtgagagaaaccttcatatgcatgtctgttggtagagcagggccttttaggtagagggaacaacatatgcaaagaagcagagacacagaatagcatagtgcgttggagtagtttagtattgcttcagcatggaagttaggggagggatggtagagagattgtgggggataagtcaggagactaaagtagggatggagcacaaagagccttttatactctgctaagaagtatggactttttttctgtgagtagtgctaagccattgagttttaagaatagcagtgacatagtgttaaaacataagatcactctggcagctctgtcgagtggagtagttagaggagtggagttggcgacacaggacaagagggggagcttttataacagttcaggcaagaaataaaagcctgaacagttaggttgagtatgtagatatttgggtatatcctatcactggttctagaccaggaatccagccaactaccagtttttataaataaagggcttttttggaacagtacacattaatttgtgtactgtctatggctgcctgcatgctacagtggcagagttgagtatttgcaataggggctgcatggcccacaaagcctattttagtgcttttattttaggtactatctgccactttacagaagtttgctggcccttgttctagactttaaatccttatcttattcacctcagagtctcccatagtaccccagatagatctaaataatgagcacatggtaggtgtccagtaaattatttttctttttttttttttgaaacagagtcttactctgtcgcccaggctggagtgcagtggcacagtcttcgctcactgcaacctctgcctcctgggttcaagtgattctcctgcctcagcctcccaagtagctgggactacaggcatgtgccaccacgcccagctaattttttgtatctttagtagagatgggttttcaccatgttggccaggctggtctcaaacccctgacctcgtgatccgcccgcctcagcctcccaaaatgttgggattacaggtgtgagccaccatgcccagccaatattttttaaatgagtaaacttacgtaactattctgaatcacgctctatccataagtcataatttccctacataatagaggtggatttgttctagctcaagaatgccaaaggtttggatggtgtgggaatattgtattgggtctttatataatggatccattcagggactatgtttttattcttccttgtttgtttgttttgagacggagtctcactctgtcgcccaggctggagtgcagtggtgcaatctcggctcactgcaagctccaccttccaggttcagccattctcctgcctcagcctcccaagtagctgggactacaggcacccaccatcacgcctggctaagtttttgtatttttagttgagatgggatcaccgtgttagccaggatggtctcgatctcctgacctcgtgatccgcctgcctcggcctcccaaagttttgggattacaggcgtgagccaccatgcccggccatgctatactgttttaataagaagagatggcaacttcaagaaaaatgatgtaaacagtgtgaaaactggtccctaccatactgatctttcatctcagaccacatgggtgcatcttgatgtaatccacagtaactagtttactagttgtcatatttttcatatgtgttggccatggaatttttctcttatttagtcatctgtcattttaactacaataatcctatcccaaaatttcactttaagccgttgtctcagtaagaaacatgctttcttcaagcatatattgggtttatctacatatgaggcaatgagggatggtgggaagatcgcagatatcgtagtcagaaggtgtggttatgcattatatttcttccacctttttgtttctgacctgtcaaggggagacactacctatctaatcagatttttatgagaatgaaagcaaatactttatataaaagtgccttgtaaactctataaatgctagttatctccatttttttaattggctgatttgagaggatatcagtacttttcaatatatgaatttctgatttttattgactctttgtagttacacattttctaattgtaaagctaaaatgtttgtcacccttgtacataatatattatccttctgatttgcaagtaagcagtagtgcaaatagttcatgtttccatcacttttttccacatgatagaattatctgtaagcttcaggtgatatgtattgacttgcgatcattgctccttgtaccaaacagctcctaacttttcaccatatcaatggaataactatgtaggcactttagggatgagaaagctatgtaagacactaaccttacccccaaaaagaaatattactaacatttcatcttctgcattttaaaaaatctgcattgtcagaaggtctttaaagactatttttccaatgactcgtccttggctaaacaaaagaagtacagttttagtcttccattgctatagatgtttgtagctttaatagtgattgatgaataaatatttaaattgaaacttataaagttgttactgaactttaaaacattcaaaacgtacaagtgttatgatgttctttctttgtattttaaaaatccattattggtgttattttgcttccttttcaaaagattgaggcctaaagaaagatttagtcaggtggactaaacaggtctttcctgttaaactgttttttcaggttttctgagacaagtggaaaatctggtcagaaacacctgttgttcatgtcatttatacttgaacctatgattgcggtcaactaaaattcatgtgacatttggttgtttttatcttgaaaggaatttctgcttcaggttgagaagattcataacccaaattttttctctaatctgttgtgaggaaataaactgaggacacacacacacacacacacacactttctctcacatacactttccacctgagtcaaagctctaagttatgtttacagaatttcataaaattatttcttatttttttgcagaatttttgattgattaaggtcattctacccttaatttaagaggaatgataagaactttgaaaggtcagatttaaaaggttatgaaatttaagggtgaccacttgatatttgctagtgttgaaatacaagtttattagtttctgcaggtataagctgaaagatgctgcctcttctatattgattagctgttataaataaaatgcaggaaaaatgttgctaattcaaacaaatgagaaaaggttttctgaaaaagtaaaaattcagaattatagactttttaaaattttacaaattttgataaaatgctaaaagtcagctaagagcagtccttagaaaatttattttaatgagcaggtaggaataattgacaattggaatattgatggcttacaattatgtaacttacagaattccttatgtgcctgaaaacagtttgttttgaaatacttcttccccacacccatcttaattcacttttaagaaaggactcagcaattaattgggtgagtcttttcttaataattagcaaaatgacaagttttataccagcttcagtcctaaaatctatcgtattttttggcaaattttgaaagatgggcaagatttttctttcatactgctgtatgtatctatcatttgaattcggttttactgtaagagaatcagaatgcaaaatattatggtaaaaacctaggcctgtgtaggaaagaggtgtttaaagtgaggctggtagctttgttgagattttaatgtttcggtcagagctcttgtcttccctttggcctgagagtttgtatcttgtagaatcctttcagatgtatcaaaaagtttgaatcagagttaaaacttttatataagggtatctaggaaggaagtcctgtatctgccttttataacttatggaaacccccaggtttgtataagtataaaatgagataatgtgatatggtgaaatgagatagtgtgtatgaacatactttataaactataaagaactgtagacatttgtatattattaattatcataattctttcacggatatgcttgtttcctgtgacaccatttttctttttttcttttttttttttttggagatggagttttcttcttgttgcctaggctagagtgcaatggcgtgatctcggctcaccacaacctccgcctctcgagttcaagcgattcccctgcctcagcctccagagtagctgggattacaggtgtccaccaccatgcctggctaattttgtatttttagtagagacagggtttcgccatgtaggtcaggctggtctcgaactcccgacctcaggtgatccgcctgcctcggcctcccaaagtgctgggattataggtgtgagccaccgtgccaggcccatttttctttttttaaacttagaaatgccaaataaatgcgattaatatttatcaaacctcatatgtgccaatataagccctattaataatttaaatgtttatgtttttttgtttgtttgtttttgtttttgagacggagtctcactctgtcgcccaggctggagtgcagtggcgccatcacaactcactgcaagctctgcctcccgggttcacgccattctcctgcctcagcctcctgagtacctggggctacaggtgtctgccaccacgcctggctacttttttgtatttttagtaaagacagggtttcactgtgttagccagtatggtctcgatctcctgacctggtgatcctattgcctcagcctcccaaagtgctgggattacaggcgtgagccaccatgcccagcccaataatttaaatgttaattgttctattgaagtaaaatatttgtctctttgttactttttactttatttttaaaagtatagaagttatagatgatggctttctttttgtaaaagattcaagaatgtcaaagcatatagggaaaaatgagaaaggccatctctaacaccactttcctttccctctccagagttagccaaaatttgggatatatctttgaagtttgttttctttatataatatttacattcatatacgtatgtgcttttttaaaaaaatgaacattaatggaattatactgcagtttacatttttcacttgcaaatattccttggatagctttctgtgtcagtgtatgtaagtccccttcattattttggacaaatgcagagtattctagaatattgccacataatggaaaatataagatccatgaacacagggaccttttctgttttatttactgctatgactccagttcctcagatagtgcttggtgtctggtaggtattcagtaaatagaattaatgaataatttatttaacatatggattatttctggttgtggctgttgaaaaaatactgttgtgaaaatgcttacttgcctccctgtgcacacaaggaatcattttctagggtagccatccaaatgtcttttcaaagacatggtttcattgtcttctagtttctagtgttgccagtgagagttatcataccaatctcgttctggtttctttgcaggaaacctgttttgtccctcagaaaggttctaggactttctcttcacctttggtgctctgaaagtttacagcagtgggtctggacagatgtgtgcttcttttcatttatcccgatcatcactcactgaaccctttaaactgcagaggcacacctttcttcagctataggaaatttttttctcttctgtcttttattgtttcttctctatgactctttctgttctctccttctgagactcctgttagatcacagttaaaacttatggatatttctttcatgctttgtagcctttctgtctcactttctgtcattttgtgggatttggggcggaagggaagataaataactgtgttctgtttgccatcttcacccagcttcctgccatagttctttttatcccacaaggatgacttttttttatatctgtcacttcatttgtctcacagtctcttcctaaaaaaaatatgactcatatttcataataattgatggaaggttgatatttatttaacatgcgtttgttttatagtcagctttttttgaaaatgctttttttttcaaagccatgataccaatttaaaaattaggctgtgttgttttgtgctattggtagtgagcccagtcgctttaaaacacgtgttggtatcttaatcactcatctggtccaggcagctccaagtgctgataaaggccttgatgcttctccagatgtctaaatgctagctccaggtgcagtaagcagactatttggagctggcacatagattctgaagcacaatgtattaatacaaatgaaagttttaggttcttggtctcctagagtaatggttcttaagcctggttcagtaccagaatcacctgtggtacttggtaaaactataaagaccctctaataggcctgttaaatcaaaatcccgtggggaatgggactgagcgcctgtatatctctgaaggctctggaggttattctgatatgcagccaagtatggctgtgttttcatttctgtatatattttctttttgtatggatttttcactgttcttactctctgtatgtattttttcttactcatgcctcatgagttaaaatggctatacagtgtcccttggtacagatgtgttctaatttacataactgatcccctcttggtagacattattaatatgcttcccatcttttttcataacaagttactttagtagatatacttgtacatataactttgtacacatttgtgaatatatttaggggataaattactagaagtggacttgttcagaggatatatatatttgtgaatttgagagatgtgttttctttgattccaatttttaaaattgttttaaaatgcccataaaattgtccgggcgtggtggctcacgcctgtaatcccagcactttgagaggccgaggcgggtggtcacaaggtcaggagatcaagaccatcctagctaatatggtgaaaccctgtctctagtaaaaatacaaaaaattagccgggcgtggtggtgggcacctgtagtcccagctactcgggaggctgaggcaggagaatggcatgaacctgggaggtggagcttgcagcgtccgagatcgcgccactgcactccagcctgggggacagagtgagactccgtctcaaaaaaaaaaaaaaaaaaaaaaaacaaaaaacagaaaaccataaaatttaccgtgtaaccattttaaatgtacaattcagtggcattaaatacattattaatgttgtgcaaccatcactaccattcatctccagacctcttttcatcttgtaaaactaaaactccatacccataaacagtaactccccattccttcctctccctatcccctggcagccaccattttactttctgtctcttggatatcagctactccaggaacctcatataagtggattgtacagtatttgcttatttaacttagcatatggtcctcaaggttcgtcatgttgcaggatatcagaattttctttctttttaatgctgaataatattccattgtatgtacgtaacacattttgtttatccattcctctgtcaatggtcatatggatttcttccacattttagctattgtgggtaatgctgtcatgaacaaggctgtacagatatctcttcaagaccctgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaactgaatatattcttaactattcttaaatcttggaagtccttacattttgtttttatctcttcttaggccagtactaaagtggaagtggacatggagaaagcagaaagcctgcaagtgacgagaggagacttccttgcttctttggagaatgatatcaaaccagtgagtatgcccattgagtgatatataggccaaaaagtaatgataataataactcaggcgaaaagtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcactcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcatgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattgcacactccttatgagaatctaatgcctgatgatctgtcactgtctcccatcacccccagatgggaccatatagttgcaggaaaacaagctcagggctcccactgatgctacattatggtgagttgtataattagttcattatatattacaatgtaataataatagaaataaagtgcacaataaatgtaatgtgcttgggctgggcatggtggctcgtgtctgtaatcctagcactttgggaggctgaggcgggcggatcacgaggtcaggagttcgagaccagcctgaccaacatggtgaaaccccatctctactaaaaatacaaaaattagctggatgtagtggtacgtgcctgtaatcccagctactcacgaggctgaggcaggagaatcgcttgaacccaggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagtattttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctcccgggttcaagcaattatcctgcctcagcctcccgagtagctgggattacaggtgcttgccaccatgcttggccgatttttgtatttttagtagagacggggtttcaccatgttggctaggctggtctcgaactcctgacctcaggtgatctgcctgcctcggctttccaaagtactgggattacaggcgtgagccactgcacccagcctcagatttaatttttgccattcagttaggtgtaaaatgagatctcatttcagtcttgatttgcattttagttattagagaacttaagcatttctccatatgttaattgaccatatgcatgtattgtgtgaaatagtgtccaagtcttttgcctgtttttctgttgtactgcttatttgattgatacaagttctttatatactctttttttctcaattttgtattgtgttaaaatacatataaagtttaccattgtaatcattttcaaatgtatagttcagtggtattaagtatattcataatgttgtataatcatcaccaccatccatctctaaaactcttttcttcttcttgaactgaaactctatacccattaaataataactcttttttccctcccctacaacacctggcagccaccattctactgtccatctttatgaatttcagtaatcttaagtacccatgtaagtggaatcatagtatttgtctttttgtaactagcttatttgacgtagcataatgtcctcaagggtcaaccatcttgcagcatgtcagaattttcttcctttttaaggctggataatactccattatatgggccaggcgtggtggctcttgcctgtaatcccagcacttttggagattgaggtgggtgggtcacctgaagtcaggagttcaaaactagcctggccaacatagtgaaaccccatctctactaaaaaatacaaaaattagccaggagtggtggcacacacctgtaatcccagctactcgggaggctgagacatgagaatcatttggatccgggaggtggaggttgcagtgagccgagattgtgccactgcacgccagcctggtgacagagcaagaccctgtctcaaaaaaaaaaaaaaaaaatccatgatatgtacataccacatgttgttatccattcctctgtcaatggcagccaggcttctgccacgttttggctattttgagtaatgctgtcattagcatggctgtacagatatctcttcaagaccctgtttttagttctttcgggtatatactcagaagtggaattgctggatcatatagtaattctatttttaattttttgagggaccaccataccgttttccacggtggctgcaccattttacattcccaccagtggtgcacaaaaattctgacttctccacatgctcaccaacaaattattttctgtttttttggtagtagccatcctaatgaatatgaagtgacatctcattctagttttgatttgtattttcgtaatgattagtggtgataagtatcttttcatatgcttatcaaccatttgttacatatccttttttttttttttttttttgagacagtcttgctctgtcacccaggctggagtgcagtggcacaatctcggctcactgcaacctctgcctcccaggtttaagtgattctcctgcctcagcctccccagtagctgggattgtaggcacccatcaccatgcccggctaatttttttgtatttttagtggagacagggtttcaccatgttggccaggctggtttcaaactcctgacctcaagcgatccacctacctcagcctcccagtgtgctaggattatgggcatgagccactgcacttggccaccatttattttatatatatatatatatatatatatatttttttttttttttgagactgagtcttgctctgttgccaggctggagtgcagtggcgcaattttggcttactgcaacctccgcctcctgggttcaagtgattctcctgcctcagcttcctgagtagctaggactgcaggcttgcgccaccatgcccgactaatttttgtatttttagtagagacgaggtttcactttgttggccaggatggtctcaatctcctgacctcgtgatccacccaccttggcctcccaaagtgctgggattacaggcatgagccactgcacctggcctgttatatattcttaacaataattatttgttccaagtatctcctttaaagacaaaagccaatttggttagccctgtctttttattactattgtgacttttaaatataaaataatcattttcaaaagtaactccaagatttttttaacaacaagtaatttggccatgaggaagtgacaactaaaaacttaattttatttattccaagggtctggaggataaaaaaaaaatgaaattatgggatatgtaaggaagatatacacgttatatatcttgggagagtcactgttttatggttcaggcatcttaaagcttctgctgtgaggcttggagtatataactggaaaaattaaagacaaaagccagcctataatttttttttttttttaaatgagatggagtcttgctgtgtctcccaggctggagtgcagtggcgtgatctcggctcactgcaacctccgcctcccgggttcaagcaattctcctacctcagcctcccaagtagctgggattacaggcacacaccaccacacccagctaatttttgtatttttagtatagatggggtttcaccacgttggccaggttggtctggaactccatacctcaggtgatccacccgcctcagcctcccaaagtgctgggattataggcttgagtcactgcgcccggccatgaaaatttcttagaacag

SEQ ID NO: 26 - DNA, 57598 bp, Homo sapiens
aatccattctgaattggccaaaatatccaacactccatcacagaaaagtatttgcagttacctgataatgccaggctctttcaagcctatgctgcattacacattactccctacaccatgcttcagcaagtccataagactcagaaaaaagtccatccttccctaggaaactacctttactgactccctccagcactcccattttatgcttgttggaagaacaagaagcactcaagaaaagatagatacctggttctacttagtctttcagacacaaagtgcagtctggaacaatgacaattagcttttactaactttcattatctatcaaacattgttaaaagcaaattataaattttaaattaactttgtaagaaggctagaaatcaggtagtaggaggagagtgtgactcctccaatttggttcttgtttttaaaaattgttttggctactggccaggtgcagtggctcacgcctgtaatcccagcactttgggaggccgaggcaggcggatcacttgaggtcaggagttcaagactagcctggccaacatggtgaaacccccgtctccactaaaaatacaaaaactagctgggtgtggtggcacacgcctgtaatcccagctactcgggaggctgaggcagaagaatcacttgaacccaggaggtggaggttgcagtgagcccagatcacaccacagaactccagcccgagtgacagggagagacttcatctcaaaaaaaaaaaaaaaaaaaattgttttggctcttgaaaatacttaacatttccatacatacttgaaaatcaatgttcaattgttaccaaaaacaacacaacataaaccaaaaaatcttgctgggatttttcactgggtttgcattgaatcattgtgtctaacattgactcttctaacacataaatacagcatacatctccgttcacttatgtaatctttttcagaagttttatggtttcagcaataaagtcattaacgtcttttgttagatttattcctaagtattttatgtttcttgatactaccgcaaatggaactgtttctccgggttatttttcagttgtttgctctaataaataaaaatagaattgacttttatatattgaccccgtacctggagaccttggctaaatctctaattctcacaggtttagggaattccatggggtttctaagtatcatatcttcaaatacaagcagttttgccctaccttttccaatttccatgcctttaattgcttttttcttgcaatattgcattagccaagacagagtacaatgtttttgtttgtttgaggcagggtctcaccccgtcgcccaggctcaagtacagtagcatgatctcagctcagtgcaacctccaccacctgggctcaagcaattctcccacctcagcttccagagtagtgaggactacaggtgcacgcccccacaccaggctcatttttgtatttttttgtagagatggggtttcgtcaggttgctggagctggtcttgaactctgaggctcaagcgacccgcccaccttggcctcccagagtgctgggattacaggcatgagccactgtgcccagcttacaatatttttaggatatatttttttcctaattgtagaccaacaaaacaagcactttcaccaagtagtgtgatgttaggcgttaggtttttttcctaatttttaaacagcatcacagctcaggaataaggtcttcacctttgattttcacgatttttactacaatgttgtgattctcatggttattattcttgaagtttcatgatttttttattttatttttgagacggagtctcactctgttgcccaggctgcagtgcagtgccatgatctcggctcactgcaacctctgtctcctgagttcaagcgattctcctgcttcagcctcccgagtagctgggattacaggtgtctgccaccacgcttggataatttttgtatttttagtagagatagggtttcaccatgttggccagactggtctcaaacttctgacctcaggtgatccacccacctcggcctcccaaagtactgggattacaggcatgagccaccgtgctcggcctaaagtttcatacatttgtaaactgactgtttaaattcaaaaatccagtcattaagttcctcaatttttttccatctttttttttctttttcctcatgactaagaatcatattctcatgtttattcatatgtatggtaattttctattatatacagacaatgtatgcaatacattatagagactctgaatttagttagcttttcctaaagagtgttgatttttgttctagcaggcatactactactacctggttaccttcattttgtggagctagttttgtttttataaaagcatagtggagtctattttggttccctccttaatcctatggtgaatgccttcgtcctgggaaacattctttaactctttaagtgtgagcctttattggtttcaatcaaagccctcaggtttttgccaagtctagttggaattcgaactccaaattctgccttccctgcattaggcaatgatgatcttctctgctcagctctttcagccttccaattactgctttccactatgccctataaaatcttccctaaacatgtgcaggtcaggggtgagcacaaagatctgaaaggggctcaaatagattgtgggcctatgcccctccccatctcccatagctccctctttgccactattcccctccttcaatttctacctaacttggcagccctgaactccatcctctgataatatacaaacaagcccatgaagcagtgactattgaattctagaagctctggggcacatggactgagaatgctctcatctcttcctggcaatactttctgtctgaaattttgctgacattgttgagtaatttacctagtaatatgcacaggttccaagcttgcccttctttgctcattactttttcttaagcaggggaaagcaagcttctatttgaagagagagaatgagaaggtggggaagataagaggcatgtttcaatacactagagaacaactctcaaccgctttttacatgctctctttccaagggcacaccctctttgttcaaaaggagtcttaaatttcacagaagcatttatctgtacacacgacttatcggcagctaccaagctagaggcccgttaagttttctctccctcagctagccttacacctttaaaactgcctttgagtcagaagtcagaatgaagaggttaaaataaaaaaagaggcatttttctaggcattcctccttaggtcttccctttctctaacccactactctgtggtataaaaacagtacccacttccctaacccagaaaatattccttgatttgctccatgactcaaaaaaggttcacccatgaattcagtctccagttcttttgctcataggttgggtccttttagaacaacttagttcaataatatctgtactgtattcaagacccaagcagatatatactggttctgtcaataaacaatcatcctgtttggaaataaagcaaaaagactatgtatccttgcagtgtaccactgggacattacctaacaagcccacccaggaaacatctgactctccataaattatttaactttgttttacctactatctataattgattagggcccagaagtcttactggatgtttattttagaacgctgacaagttaaagttggtttgcatcttgttgaaaacaatgtccaaagttacagctttattgttctataggatattaataacttttgtatgctactgagtaatcatattcctgcattcttcctttttatctggtattaaaatactgttaacagtttggccaccatcatgattcccttgttattcagtaaatcactatatatttaggaattatgtctaggctggtgcagtggttcacacctgtaatcccagcagttttggaggccaaggccagcggattgcttgtgctgaggagtttgagaccagcctgggcaacttggtaaaaccccatctctacaaacaatacaaaaattagccagacatggtggcacatgcctgtagtcccagctacttgggaagctgaggtgggaggatcacttgaacctgagaggtagaggctgcagtgagccaaggtcgcaccactgcactccagcctgggtgacagaataagaccctgtctaaaaagatggaaagaaagagagaaaaagaagagagaggggagagagagacagagagagagagaaagaaaaagaaaagaattatatctaatgttttgaaactatattttgacaattctaaagacgctgatttttttgttaattccagctgagtttcagaaatgagaataaaaaaattaaacataacagaaaatacctctgacattattatttttaaactacaagtcttcaaatatatttttgggtaataaacaagcacagtccaggagtttgaggctgaagtgagctatgattgtgcgattacactccagcctgggtgacagagcaagagcctgtcttaaaaaaaaaaaaaaaaaaaaaaaaggaataaatacacctacctccatttggggaaaaaattaacaaaatggaaaacaggctggttacatgtgggtatgaaaacctacagttgccctctgtcccgggcaacctaatttttttttttaagcaaaactgagaaaagtcactttcctaaaatttaaaacaaaacaaaacaaaaaaacctggggaacaaacaagcaaagttaaatactgccttcttatacagaaaaactttgcctggcaattgacatacgcacagctttgcaaatatttggcattttaaaaatttaagtcaatagcttttaagaaacatatgctctgcgcccattctactaataataaacaatggaaatgtattgtccctgctccccccaccccaccccccaacccctgtcttctcttaatactttctgaacgcttttcagaaagcatggatatattcataaagggtagataattcacgaaaacagggaaggggtaatctctccttgacaaaatagtgacagtgtatacttagttgttttcattatttattttactcaatccaaaaagcattctattgcacaatgttgaaactagtatggccaacacaaagggaaagatggtcttgaccttcaagaatcttacaatttaatacacacacaggaatcttacaatttaacacacaagtaaatgaatgaagggtagggaaaggaccaagctcctaaagagtgtgtgtgtacaagtgaatctgtataaactgtctcacaatcactgtggattttttaagacaatgaggattagtaacacaatggaggactgttatgccctgtccttcagaagtgctgaggtaagagaaaacatgactacagggagattactcaaaaaagtttggaatccctaaattctatatacaaatatataagtatctacatagaacttactcccctatcacatatgcctcatgtttcatgtttcctgtacccataccaccaatgtatctatgtttcctttctcacttaacaatttttaccctgattagaccattcactaaaagtttcattaataacttaaaaaagatctgtaaacagcatgcaatgaacttatattatagacttaaatagtggcaaaacttggcattctgctctttaatttattcaaaactactttccagttaagaactatcaatcttctagtgtcttcacatttatctctagcaacagtggctggctttcaaaattaggtgagagatctttccaagatctaaacatctccaatatctgcctcagagaaaatttagtttccaccacatcatgcgttcctgctaacaatgattaaaataaataaaagaactataaggttggtttatttgcggatacaagaacagcttgcttaactcaccatttaaaaagccatcacttcacactagctttattatctgaagcataatcaaaataataaactacggttgtgggactttggaatttctaattaagttatggagacttaaatcaagaaatatgaatattcataaaacccagtaaccttttaggcaaagtaaaaaagtgaaaagaacaagtgctcttggaattcagaaagaaaattaactatggtattgagagaaaccaggaaagagaaggaatcacagtagagctaggatacagaaggaaacagaaaatgacagtttaatgctcattatagaataacagtgaatcacccacagagaccattttcagtgttcttgtgaatttaacctctagtctaaccttttaatgaaaaggctataatatattagagtggcccagaaaggtgaccttatgtctcaggtgtcagagccacacccaggtctcctgattcccaatgatactccctaaagccttacttgctctggctgtagtgttttgagaattggagctgcttttaatcctatggtcagctacacagctgcaggatgggccctagattccctattcaggaattcagatcttaaaacaccaaaagtgataaaagtagatacagttccccttcttcagccaatgcaaggatcctagttacagagaaaaaacggtgtgccaagacaacacccttaattctcacgcatttccccctttctatcttttatacttaccaatttatcagtcccatgatctgtcttcacctcagaactaagtggaagaaataagtctgttgtatgctctgggggaggtacctccccaagaactatcaacccctgcaggatagagaggagaaaaatagcataagtgagcagtataaacttcaaatttaatttaggagttaagtctcaaaaggactgttggtgtactagaggccccctcttcctcaccctatggttcagaaacaaactacagcagcagcagctttgttttcccaaagagctatttcaacaagcagcagacccaggctcccctctctgccacttgactgctctgacctacatggctcatcagccatttagcatctttattcatatctttcagatatgaaatctttaccagattatggcatttataccatattactagactccactagattaacagcagcaatgcagtttttgtagccaacaaatgcagtttatgacttactaagctgaaaatgctactattcttaatcatgtactccaccaactatacctgcacaaacaaaactgaatgaaacaaatgtggaacagtcccctacaatttatgagaaaccaagagcttcttaaaagctggcccaaaggaacctgcttttttcataagcataaatattacttcagattaagttcctgcttgacaatttcaaattcagacctttggaaattcattccaggaaacaatttacataaaaagaaattaaaaatgaacccacaagtcctccccattgtacatataatgagccaggatgggtaaaggcagaaggtatcttattattaaaaaaacaaaatactacatatgaatcccaccatgtataccagaagaggtgacaaaaataaggctatgacactatataaccgaaagactgggatgcaagtgatcagggttcccaatctctttctctggtctaaaaaatagagatctaactagattaagaagctcttaatggaaatttattatcagaatcacctggggaaccttatcaaactatactggcttaggtccaacatctactcagtacctctgggggtggggccaggtagtctacctttttatgggggaagggaggcaggacatggtgggtacatggaggtgggtgtctctctcctcccccaccccgccaaccccactatgttaccgaggctgatctcaaactcctgggctccagcaatcctcccacctcagcctctggagtagctgggatgacaggtgcctaccaccatgcccagaggtggatattctactattctttaaaagctcccctggtaagtcctaaacttgtaaagttgaaaaacactagacttgattagtttgggctcaaagaacatcctaaagtatagatttgggggactagggattgtgactattagtcttagctctctaggccatacgacagactcttatgagccactaaaccagatgatccatccctggggtccttgtaactaaaaaaccaatatgaaatacaagctgcagaaaaggggaaaacattaagaaagaaaaatggaattttatttcagtttttaaaaaagaagtatgtatctctttttctcttgaagcaaaagaagcactgcctccctattctggaatatgactacacttagcctgtatcaaaaatgaattggagggtcccggaatggcggctcacacctgtaatcccagcactttgggaagctgaggcgggtggatcacctgaggtcgtcaggagttcaagatcagcctggccaacatggtgaaaccccatctctactaaaaatacaaaaattgcccaggcgtcgtggcacatgcccatagtcccagctactcggaaggctgaagaaggagaatcgcttgaactcaggaggcagaggttgcaatgagccaagatcacaccattgcacaccagcctgggcgacagaccaaggctctatctccaacaacaacaacaacaacaacaaaaatgaattggaggctgggtgtggtagatcacacctgtaatcctagcacttggggaggttgaggttaggagtgcgagaccagcctggccgacacagtgaaacaacgtctccagtaaaaatacaaaaaatagctgggcgtggtggtgagcccctgtaatcccagctacttgggaggctgaggcaggagaatcgcttgaacctgggaggtgtaggttgcagtgagccaagactgtgccattgcactccagtctgggcaacgagagcgaaactccacctcaaaattttaaaaattaaaaaaaaaaaaaaaaaaaaaaaaaagaattggagtctcctcagaaacaagagaaaggccattaactagtaagcaagaaacattaaccctagcctttaaaatgaggtttctctggttaaagaacttctgcttcaaaatattttcttccctaaatcaaaagcataaaatataccttacaaactttatcacatccaaataaaaactatttgcaaaagacagttatcttgtacaccactgccttctcaaaacgttgtattcaacagatattccctacttaagggcccaaactgtcttcctgcttcctgtacaaagcatgccaaaaatcattttattattcaaattttcccataaccggttcctaagaacttttttaaagatcaatttccaactactttccccaaatatttgttagtgttataccaatctcatcatctcctagacaaatgtttcaatgaatgtgaagctgttgctgctgctggaggtaagggttattagtcagtagaaggttaaaaaaaactgaattaaaggttaacacatgagctgttcatctttatttatactcatttttatattttatcagtccaaattgccgttcgtccttccaaagagattttcaacaagtcccacctccttccaagaaaatgtcccgggttaatgagttcctacttgctttatccacactgccagacctcctaaagcacggtgattgtatcttactttctgtgtatttaaatctcatttccagagcattcataatcttatgccacattatttatttcacttattattgcctcagtttcttgtttgttgagacagggtcaagctctgtcacctgtgctggagtgcagtggtgtggtcacgaatcactgtaacctccccctcccgggctcaagtgatcctcccacctcaaccccataaatagctgggataacaggtgcatgccaccacatccagctaatttttgtatttttttggtagagatggggtttcaccaagttgctcaggctggtctcgaactcttggactcaagtaatgcacttgcctcaaactcccaaagtgctgggataacaggtgcaagccaccacacccagctaattgttctattttttggtagagatggactttcaccatgttgccaaggctcgtctcaaactcctagactcaagcaatccacctgcctcggcctctcaaagtgctgggattacatgtgcaagccgctgcacccagcctttaattgttaactaatgttagtttattgaagatgtggacaaaatacaaatatatttaaatgacccatgtcccttagcagagtcatacaccaagaaaataaatgcatagcaaatatttgttgagttgtataatttttttcctaacaggaaaatattaactttataataattatagccagaagataaataaatctaacaattagatataaaattactccttcaatttttctttttcagttatatgaaagtaaggacgcagtcagtattttccaaagggaagaatttttccttaaactacagaataatttctaaatacaaccctcagatagattatgaagacatctcctaagagagtataataaaacttggtagggaccatctattcatcgacataattttatagacccacagaggatgtaggtcaaagcttatgtctctacaggccaatacatggcagaactggggcaaaagtctgcatctaactaatatttcattcctcttttgttcagttaattcaatcatttatccgctcatcagcatttgttaggtactaaggatacaagaaaaaatgagagacctatccctctcccctaacccatccttcaaagtgcttattacgttctaatactgcggcaaagaaaaacaatgtaaataggtaaatgttatgtactacattagaaggtattaaatgctagagagaacaaaatataggatagtgaggggattaagaagtggaaatggtggggttggtcgtgacggctcatgcctgtaattccagcactttgggaagccaatggaggaggactgcttgaggccaggagttcaggaccagcctgggcgacgtggcaaaaccctgtctccacaaaaacaataataataaaaattagcctggtgtaatatcacacctgtagttccagatattcaggaggatcacttaagcccaggagagagagagagatacaagtgggagggggtactacaggcgcataccaccacgcctggctagttttttgtatttttagtagagaaggggtttcaccatgttgccaaggctggttgcaaactcttggggccaagagatctacccgccctggcctcccaaagtgccgggttgcaggcatgagccactgtgcccctgcttgaatgtttatttgaagacagaatcaaccagctatgccaatgtgcttacaagataggagggaaaagagtcagagacactgccaaggtttctagcttccacaaccagaagaatggaactcttcttcatttgttcagaggacatttgaatacacattagttttaattaaacctatttttgaaaatatgtgctcaagtgttacactgaagcaaccaacaatcatccatacactgtccattgcccccaagatatgtaagttcactatggcattcaaaaccaaacactggatcctctaatttaatactgtacctcacaccaaaaaggatgaaaacagctaaaaagaggctgagcaaataaaaagcatccaagtaggtaagagtcattcatgcaggtagcatctattgagtggctaccacgtgcaaggtagtgtgaaaacacagtaataaaataaaaacagattctaccataaggagcttatgttcatctagccttgaacagacaaagagacaaagtattatgacagtactataacagaagttgagagaaggtgatgtcagagcagaaaagagcctaactgaagagactgatgaaagtgaggctttacagaggaggtctacataattacttaacattccccaaaatatatttaatatattttgagctatacttattcattaactatacacttaatgactttgcccttttctgtatacaatgtttcatatgccacaataacacttatttcggataaagtttactcatgtttaataaccatgaaaagaaaggttagcattagctgagaaaacttcataatgttctactccacacctgtcatgctaccccaacatgggcttccctaacattccaggtttaaactgggtcagtgttgaatagctgtgccattagcctggtggcaataaacttagggctgctgtactatgaaatagcaaccggtagaagccgaagaaaaaggtcaagagtctccttttccttcgccatgtcccgagtcagagccaggatcatgcttaggctgcacaggcctagaaaactccaagagtgaagcaagcttctgctttacacaaggaccaaaggaactggaatgggtcacagttacatgcagccttaatacctcctaagtgactcctctgtggatgaaccctctctcaactgtatttgcaatacagctaacaggcaatttcacatacttccttacatcactctatcaggtcaatcttccctatgcatctcaagacaaaccagtgaccccactgcagaccagttccacaagaatcaccctgggctacctggaaaagataagttgtctaaagtgctttaaaaaaccctattaagatgagaacttcaacagctttatgaaaattttgaagagaaaggtgttataagcttctgcagttcccattcaactccttccctattcaaaagtttcaatgctcttccacctcccatcctcaataacatttccatcctcagctacagctgtgtaatctcaaagagtagtcagaagaggagattttaaaaaacaacgtaagagtcaagccagtgcttctgggaggccaaggcaaggaggatcacttgaggtcaagagtttgagaccagcctggacaacacagcgagaccccatcctttaaaataaaaaaaaccctttaacaattagctaagcatggtgggacttgcctatggtcccagctacttgtacttgcaaggctaaggtaggaggatagcttgagcccaggagtttcaggttacaaagaactatgatctggccattgcacctcagcctgggcaacagagcaagaccctgcctcttaaaaactgcttagtccctattctttcccctcatttaccaggtgtgaaatttcaacaaacatgtttcagtgaaatgatgaaaaggacacaacagcaaagtatgttagaaaaaaaatgctttggaatcagataaaaagtcctgagtttaaatttagctctgccttttacaagcctctgaagatttattctgatcattaaacgaacatacatgagtaaacctttaattagtatacactcaaggtacgtatattgttttcgtttctccttctaaagcatggaagagtttctttttaaaaaacaagctgacaaactatgaaaattaaaagagtacaacagcatgcagaagtagtacagaggagttcctagaagttatattctttctccagagagcaatattattcccaaaagggactctactcacttcacagcttggaaggtaatacctaccttctgacagaacagaaactggtgtctggatcctagaatcacctagcagtagtcacaaatactttttttttttttggtaatacgccacttaaataaaattaatgttaataagcaacaaagtaaatccttaaaaagaaaagccccaccatccctccaatctcccacccgaagacaaattataactcaacagcctatcaccaagattcagcctatcacctaggttcatctcaaaaaaaaaaaaaagacctgtgcaacccaggaagtgctgggaaatcttggtgcagcatggaaaatatgaacaccaacccacttaaccaaaacacataggaaaaactttcttccatttcagtaactaaaaaaaaaacccaagcacttaaagtgattactaacttgagcaatagctctgcactcacttggatgtgtaaccatgaacaaactacttgactgctctgatcttccattgtttatcttgaaaatcgtgaatgagagtaaaatgcttagcacagtgcctgacatatcacaagtgctcaaaaacttctattaattatagtgttacataaagactaaatgcatgtgaatatatcattgggggaaaattccatggcttgttagagcaagttgaatattgtctcttccaaatttatgttcacccagaacctgtgactatgaccttgtttagaaaaagggtctttgcagatgtaatcaagttatgaagagccatttagtgtgggctctaaattcaatatgactggtgtcctcctgacatggaaatctacacagatgcaaagagaaagatggtcatatgaagatggaggcagcaactgcagtgatgtagctacaggccaagaacaccaaggactagcacaatatcagaagctggaaaaagacaaggaaggattcttccctagagcctccatagagaccatggcccttttgacaccataatttcagacttctggcctccagaacggtgagagaacacatttctgattttttaagccatcccatttgtgatagtttgttatgacagtctaggaaactaatccatttgttgaaaaagaaatgtataaatacgacacgtaaagctgtgaattttcttgatgcattacttattggaactatcaacctagttttattcttcctatcggaactctgagaagtaaaagattatctatgatgttgtattttacagaccaagaatctgaagctcagaaatgttaagtgacttttcttctcaaggttcatgtaagcagctggtagcaaagccacgattagaaacaaaaatttaccaagtccaagtatggtgcttaatacaatacgctttgaatgatgaaactcttggataagcaacatacattcatgtgccaaatagcattatggtcaatgacagaccacatatacaatgatggtcttataagattttaatacagctgaagaatacctgttttagcacaaagcactactcctgtgtttgtggtgatgctggtgtaaagaaacctacagtgctgctattagaagtataccacatacaattatgtacactaagaatataatagctgataataaaagctatgttactgttacacttatttcttatgataataaaaagtgttatgtatttactatactatacttttaatcgttattttagagagtacttctactcattaaaagaagtgaactgtgaaacagcctccagcaggtccttctgttggcactgtcacaggcaatgaaagctccgtgtgtgttgttggccctgaaaacctaacagtgtaacaagatgtgaaggtggaagacagtaataccgacaaacctgaccccatgtgggcctacgttcatgtgtgtgtttgtgtcttagtttttagcaaaacagtttaaaaaataaaactttcattttaaaatggaaagttttaaagatagaaaaaagcttgtagaataaggtgtgaagaaaatatttttgtacaattacaatgtatttgtgttttaggctaagtgttattacaaaagagtcaaaaagttttaaaaacttaaaagtttataaagcaaaaagttatagtaagctaaggttaatttattattgaaaaaaatatttaaaataaatgtagtgtagcctcggtgtacagtatttataaagtttatagtagtgtacagtcatgtcccaggcttttcaatttcagttacccttcacccaccgactcacccagagcaacttccagtcctgcaagctccattcatggtaagtgccctatacaggtgtaccatttttatcttttctactacatttttactgtattttttctatgtttaggtatgtttaaatacataaatctttaccactaattgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatatgagacagagactcgctctgctttgcccaggctggagtgcagtgtcgcgatctcagctcactgcaccctgtctcccaggttcaagtgattctcctgtctcagcctcccgagtagctgggattacaggcacccgccaccacacctggctaatttttttgtatttttcatagagacaggggtttcaccatgttggccaggctagtctcgaactcctcacctcaggtgacccacccaccttggactcccatgcctcggcctcccaaagtgctgagattacaggcgtgagccactgcgcacggccctcagcttgaatttaagtgcactttatgatgttcacgcaccaatgaaatcacctaacaacacatttctcagtttcccttttgttaagcaatgtgtgatggtatatacaaaactccagattattttccagatatttagaaatacttttcagatattttgatattttgaaagtttctgaaaattgctctgtcattacttctgagtgatgagctgaagaataaagcatgaaccaaatgaggtgagtatcttcttatacacagctagtgagactataaactgacactgccaaaatacttctctgaagaatgcattaagaacataaaagagcattcatacctttgactgagataaagatatttatcatggcatatttaatttaaataacaaatgtaacttaaatagtcaacaaagaaagccaatagcatgcagccattaaaaatgttttccaaaaaccaactgggaaatattcagggcacatacgtaacatgactgtatttgaacaaattacttatgtgctaggaaaatgtaccataatgttggtagcgagataattttgagctgttgggttgttttttttttttttggggggggggggagggtgggtgtcttttatacttctatgtcatttcagtttcctgagaattgatacacagtatttcatcaattctaagaggtactctccccacatgtcaacaacttttaaatcaagatgcattttacaatttctgttatgccctggtttaactgaaataatttctttgtcgtacttaaaacaatggtacatcttacaatcaatagcatcttaagttctatgaaatgtagcagttttataacaaggaactaagatgatataacatatacacatatataaacccacatatatatttatgaatgtatataaaaagatgaagcagcacttatgactactattatactaatctcagttgttactaagagactctagttctcaaatatagaaaatcccacttaactactggctataaaaacctagaaacagacactgaagaggtgtctctgatagagaaagactgtgtttttctcctcagtacaggcatatccagtcacctcctagttattcttagtcatcattccagttcaagttctacaaatctcactttaaaatttcctttgtgaagacttgggaaagcaaaatatgcaccaaatctagaatgtttattagttttgttccagctaatttttaaataagtaaatcaggatttaatttgtatgctaccctaagggaacaaactagtaagaataaaaaagtgagccctctggactgtgtcctcaattaaagtatgctctattgaacttttagggggagggggaatatatatatatatatgtatctccaatctggaaagaagctataagtccgcagtgacatttttagaataaaagtttaaatgattagatagcccacagaactttcacttcaaaccctgatcattctgttcattttatcagttgatcaaccttcaacttttggcctactaatttaatggatactgttcacaggaaagccattttcttaaggctttgactagtactaaggtcaaaaaggcattttgacccttatttttagtagcaatagactttttctagacatgggtctacataaagatagagctcagccacaccaagctaatataaaaaatactttgcaagaatgtaagcttcatgaaggtaggatttttgagaacactgctgagacacagtaagcacttaaaataatggtacatcttaccatcagtagcatcttaagttctatgaaatgtggcagttttataacagggaactaacaaatataaatctaacaaatatgacagttaacatcaatggcttgcttgcattattcagtctgttttccttgtttcctgttagctcagatacccacacagttttgttctaaatacacgttcagttaaacattatattctaatagtgttttcctttttatgagacaggcctttcttagttgtccaggctggagtgtggtggcacaatcttggctcactgcaacctccacttcgtgggctcaagcgatactcccacttcagcctcctaagtagctgggactacaggcacatgctatcatgctcaactaatttttgtaatttttgtaaagacaaggtctcactatgttgcccaggctggtctcgaactcctgagctcaaatgatcctcctgccttggcctcccaaagtgctgggatcacaagagtgagccaccacgcgcagccacatcaggttcttaaattaaaccactatatcaggtcattaaaccatttactttgcaatagttaagaagagggttatgggggttacgaggtgggaggggatgtgagaaaagcgatattgatagttttcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaag

SEQ ID NO: 27 - DNA, 70380 bp, Homo sapiens
aatccattctgaattggccaaaatatccaacactccatcacagaaaagtatttgcagttacctgataatgccaggctctttcaagcctatgctgcattacacattactccctacaccatgcttcagcaagtccataagactcagaaaaaagtccatccttccctaggaaactacctttactgactccctccagcactcccattttatgcttgttggaagaacaagaagcactcaagaaaagatagatacctggttctacttagtctttcagacacaaagtgcagtctggaacaatgacaattagcttttactaactttcattatctatcaaacattgttaaaagcaaattataaattttaaattaactttgtaagaaggctagaaatcaggtagtaggaggagagtgtgactcctccaatttggttcttgtttttaaaaattgttttggctactggccaggtgcagtggctcacgcctgtaatcccagcactttgggaggccgaggcaggcggatcacttgaggtcaggagttcaagactagcctggccaacatggtgaaacccccgtctccactaaaaatacaaaaactagctgggtgtggtggcacacgcctgtaatcccagctactcgggaggctgaggcagaagaatcacttgaacccaggaggtggaggttgcagtgagcccagatcacaccacagaactccagcccgagtgacagggagagacttcatctcaaaaaaaaaaaaaaaaaaaattgttttggctcttgaaaatacttaacatttccatacatacttgaaaatcaatgttcaattgttaccaaaaacaacacaacataaaccaaaaaatcttgctgggatttttcactgggtttgcattgaatcattgtgtctaacattgactcttctaacacataaatacagcatacatctccgttcacttatgtaatctttttcagaagttttatggtttcagcaataaagtcattaacgtcttttgttagatttattcctaagtattttatgtttcttgatactaccgcaaatggaactgtttctccgggttatttttcagttgtttgctctaataaataaaaatagaattgacttttatatattgaccccgtacctggagaccttggctaaatctctaattctcacaggtttagggaattccatggggtttctaagtatcatatcttcaaatacaagcagttttgccctaccttttccaatttccatgcctttaattgcttttttcttgcaatattgcattagccaagacagagtacaatgtttttgtttgtttgaggcagggtctcaccccgtcgcccaggctcaagtacagtagcatgatctcagctcagtgcaacctccaccacctgggctcaagcaattctcccacctcagcttccagagtagtgaggactacaggtgcacgcccccacaccaggctcatttttgtatttttttgtagagatggggtttcgtcaggttgctggagctggtcttgaactctgaggctcaagcgacccgcccaccttggcctcccagagtgctgggattacaggcatgagccactgtgcccagcttacaatatttttaggatatatttttttcctaattgtagaccaacaaaacaagcactttcaccaagtagtgtgatgttaggcgttaggtttttttcctaatttttaaacagcatcacagctcaggaataaggtcttcacctttgattttcacgatttttactacaatgttgtgattctcatggttattattcttgaagtttcatgatttttttattttatttttgagacggagtctcactctgttgcccaggctgcagtgcagtgccatgatctcggctcactgcaacctctgtctcctgagttcaagcgattctcctgcttcagcctcccgagtagctgggattacaggtgtctgccaccacgcttggataatttttgtatttttagtagagatagggtttcaccatgttggccagactggtctcaaacttctgacctcaggtgatccacccacctcggcctcccaaagtactgggattacaggcatgagccaccgtgctcggcctaaagtttcatacatttgtaaactgactgtttaaattcaaaaatccagtcattaagttcctcaatttttttccatctttttttttctttttcctcatgactaagaatcatattctcatgtttattcatatgtatggtaattttctattatatacagacaatgtatgcaatacattatagagactctgaatttagttagcttttcctaaagagtgttgatttttgttctagcaggcatactactactacctggttaccttcattttgtggagctagttttgtttttataaaagcatagtggagtctattttggttccctccttaatcctatggtgaatgccttcgtcctgggaaacattctttaactctttaagtgtgagcctttattggtttcaatcaaagccctcaggtttttgccaagtctagttggaattcgaactccaaattctgccttccctgcattaggcaatgatgatcttctctgctcagctctttcagccttccaattactgctttccactatgccctataaaatcttccctaaacatgtgcaggtcaggggtgagcacaaagatctgaaaggggctcaaatagattgtgggcctatgcccctccccatctcccatagctccctctttgccactattcccctccttcaatttctacctaacttggcagccctgaactccatcctctgataatatacaaacaagcccatgaagcagtgactattgaattctagaagctctggggcacatggactgagaatgctctcatctcttcctggcaatactttctgtctgaaattttgctgacattgttgagtaatttacctagtaatatgcacaggttccaagcttgcccttctttgctcattactttttcttaagcaggggaaagcaagcttctatttgaagagagagaatgagaaggtggggaagataagaggcatgtttcaatacactagagaacaactctcaaccgctttttacatgctctctttccaagggcacaccctctttgttcaaaaggagtcttaaatttcacagaagcatttatctgtacacacgacttatcggcagctaccaagctagaggcccgttaagttttctctccctcagctagccttacacctttaaaactgcctttgagtcagaagtcagaatgaagaggttaaaataaaaaaagaggcatttttctaggcattcctccttaggtcttccctttctctaacccactactctgtggtataaaaacagtacccacttccctaacccagaaaatattccttgatttgctccatgactcaaaaaaggttcacccatgaattcagtctccagttcttttgctcataggttgggtccttttagaacaacttagttcaataatatctgtactgtattcaagacccaagcagatatatactggttctgtcaataaacaatcatcctgtttggaaataaagcaaaaagactatgtatccttgcagtgtaccactgggacattacctaacaagcccacccaggaaacatctgactctccataaattatttaactttgttttacctactatctataattgattagggcccagaagtcttactggatgtttattttagaacgctgacaagttaaagttggtttgcatcttgttgaaaacaatgtccaaagttacagctttattgttctataggatattaataacttttgtatgctactgagtaatcatattcctgcattcttcctttttatctggtattaaaatactgttaacagtttggccaccatcatgattcccttgttattcagtaaatcactatatatttaggaattatgtctaggctggtgcagtggttcacacctgtaatcccagcagttttggaggccaaggccagcggattgcttgtgctgaggagtttgagaccagcctgggcaacttggtaaaaccccatctctacaaacaatacaaaaattagccagacatggtggcacatgcctgtagtcccagctacttgggaagctgaggtgggaggatcacttgaacctgagaggtagaggctgcagtgagccaaggtcgcaccactgcactccagcctgggtgacagaataagaccctgtctaaaaagatggaaagaaagagagaaaaagaagagagaggggagagagagacagagagagagagaaagaaaaagaaaagaattatatctaatgttttgaaactatattttgacaattctaaagacgctgatttttttgttaattccagctgagtttcagaaatgagaataaaaaaattaaacataacagaaaatacctctgacattattatttttaaactacaagtcttcaaatatatttttgggtaataaacaagcacagtccaggagtttgaggctgaagtgagctatgattgtgcgattacactccagcctgggtgacagagcaagagcctgtcttaaaaaaaaaaaaaaaaaaaaaaaaggaataaatacacctacctccatttggggaaaaaattaacaaaatggaaaacaggctggttacatgtgggtatgaaaacctacagttgccctctgtcccgggcaacctaatttttttttttaagcaaaactgagaaaagtcactttcctaaaatttaaaacaaaacaaaacaaaaaaacctggggaacaaacaagcaaagttaaatactgccttcttatacagaaaaactttgcctggcaattgacatacgcacagctttgcaaatatttggcattttaaaaatttaagtcaatagcttttaagaaacatatgctctgcgcccattctactaataataaacaatggaaatgtattgtccctgctccccccaccccaccccccaacccctgtcttctcttaatactttctgaacgcttttcagaaagcatggatatattcataaagggtagataattcacgaaaacagggaaggggtaatctctccttgacaaaatagtgacagtgtatacttagttgttttcattatttattttactcaatccaaaaagcattctattgcacaatgttgaaactagtatggccaacacaaagggaaagatggtcttgaccttcaagaatcttacaatttaatacacacacaggaatcttacaatttaacacacaagtaaatgaatgaagggtagggaaaggaccaagctcctaaagagtgtgtgtgtacaagtgaatctgtataaactgtctcacaatcactgtggattttttaagacaatgaggattagtaacacaatggaggactgttatgccctgtccttcagaagtgctgaggtaagagaaaacatgactacagggagattactcaaaaaagtttggaatccctaaattctatatacaaatatataagtatctacatagaacttactcccctatcacatatgcctcatgtttcatgtttcctgtacccataccaccaatgtatctatgtttcctttctcacttaacaatttttaccctgattagaccattcactaaaagtttcattaataacttaaaaaagatctgtaaacagcatgcaatgaacttatattatagacttaaatagtggcaaaacttggcattctgctctttaatttattcaaaactactttccagttaagaactatcaatcttctagtgtcttcacatttatctctagcaacagtggctggctttcaaaattaggtgagagatctttccaagatctaaacatctccaatatctgcctcagagaaaatttagtttccaccacatcatgcgttcctgctaacaatgattaaaataaataaaagaactataaggttggtttatttgcggatacaagaacagcttgcttaactcaccatttaaaaagccatcacttcacactagctttattatctgaagcataatcaaaataataaactacggttgtgggactttggaatttctaattaagttatggagacttaaatcaagaaatatgaatattcataaaacccagtaaccttttaggcaaagtaaaaaagtgaaaagaacaagtgctcttggaattcagaaagaaaattaactatggtattgagagaaaccaggaaagagaaggaatcacagtagagctaggatacagaaggaaacagaaaatgacagtttaatgctcattatagaataacagtgaatcacccacagagaccattttcagtgttcttgtgaatttaacctctagtctaaccttttaatgaaaaggctataatatattagagtggcccagaaaggtgaccttatgtctcaggtgtcagagccacacccaggtctcctgattcccaatgatactccctaaagccttacttgctctggctgtagtgttttgagaattggagctgcttttaatcctatggtcagctacacagctgcaggatgggccctagattccctattcaggaattcagatcttaaaacaccaaaagtgataaaagtagatacagttccccttcttcagccaatgcaaggatcctagttacagagaaaaaacggtgtgccaagacaacacccttaattctcacgcatttccccctttctatcttttatacttaccaatttatcagtcccatgatctgtcttcacctcagaactaagtggaagaaataagtctgttgtatgctctgggggaggtacctccccaagaactatcaacccctgcaggatagagaggagaaaaatagcataagtgagcagtataaacttcaaatttaatttaggagttaagtctcaaaaggactgttggtgtactagaggccccctcttcctcaccctatggttcagaaacaaactacagcagcagcagctttgttttcccaaagagctatttcaacaagcagcagacccaggctcccctctctgccacttgactgctctgacctacatggctcatcagccatttagcatctttattcatatctttcagatatgaaatctttaccagattatggcatttataccatattactagactccactagattaacagcagcaatgcagtttttgtagccaacaaatgcagtttatgacttactaagctgaaaatgctactattcttaatcatgtactccaccaactatacctgcacaaacaaaactgaatgaaacaaatgtggaacagtcccctacaatttatgagaaaccaagagcttcttaaaagctggcccaaaggaacctgcttttttcataagcataaatattacttcagattaagttcctgcttgacaatttcaaattcagacctttggaaattcattccaggaaacaatttacataaaaagaaattaaaaatgaacccacaagtcctccccattgtacatataatgagccaggatgggtaaaggcagaaggtatcttattattaaaaaaacaaaatactacatatgaatcccaccatgtataccagaagaggtgacaaaaataaggctatgacactatataaccgaaagactgggatgcaagtgatcagggttcccaatctctttctctggtctaaaaaatagagatctaactagattaagaagctcttaatggaaatttattatcagaatcacctggggaaccttatcaaactatactggcttaggtccaacatctactcagtacctctgggggtggggccaggtagtctacctttttatgggggaagggaggcaggacatggtgggtacatggaggtgggtgtctctctcctcccccaccccgccaaccccactatgttaccgaggctgatctcaaactcctgggctccagcaatcctcccacctcagcctctggagtagctgggatgacaggtgcctaccaccatgcccagaggtggatattctactattctttaaaagctcccctggtaagtcctaaacttgtaaagttgaaaaacactagacttgattagtttgggctcaaagaacatcctaaagtatagatttgggggactagggattgtgactattagtcttagctctctaggccatacgacagactcttatgagccactaaaccagatgatccatccctggggtccttgtaactaaaaaaccaatatgaaatacaagctgcagaaaaggggaaaacattaagaaagaaaaatggaattttatttcagtttttaaaaaagaagtatgtatctctttttctcttgaagcaaaagaagcactgcctccctattctggaatatgactacacttagcctgtatcaaaaatgaattggagggtcccggaatggcggctcacacctgtaatcccagcactttgggaagctgaggcgggtggatcacctgaggtcgtcaggagttcaagatcagcctggccaacatggtgaaaccccatctctactaaaaatacaaaaattgcccaggcgtcgtggcacatgcccatagtcccagctactcggaaggctgaagaaggagaatcgcttgaactcaggaggcagaggttgcaatgagccaagatcacaccattgcacaccagcctgggcgacagaccaaggctctatctccaacaacaacaacaacaacaacaaaaatgaattggaggctgggtgtggtagatcacacctgtaatcctagcacttggggaggttgaggttaggagtgcgagaccagcctggccgacacagtgaaacaacgtctccagtaaaaatacaaaaaatagctgggcgtggtggtgagcccctgtaatcccagctacttgggaggctgaggcaggagaatcgcttgaacctgggaggtgtaggttgcagtgagccaagactgtgccattgcactccagtctgggcaacgagagcgaaactccacctcaaaattttaaaaattaaaaaaaaaaaaaaaaaaaaaaaaaagaattggagtctcctcagaaacaagagaaaggccattaactagtaagcaagaaacattaaccctagcctttaaaatgaggtttctctggttaaagaacttctgcttcaaaatattttcttccctaaatcaaaagcataaaatataccttacaaactttatcacatccaaataaaaactatttgcaaaagacagttatcttgtacaccactgccttctcaaaacgttgtattcaacagatattccctacttaagggcccaaactgtcttcctgcttcctgtacaaagcatgccaaaaatcattttattattcaaattttcccataaccggttcctaagaacttttttaaagatcaatttccaactactttccccaaatatttgttagtgttataccaatctcatcatctcctagacaaatgtttcaatgaatgtgaagctgttgctgctgctggaggtaagggttattagtcagtagaaggttaaaaaaaactgaattaaaggttaacacatgagctgttcatctttatttatactcatttttatattttatcagtccaaattgccgttcgtccttccaaagagattttcaacaagtcccacctccttccaagaaaatgtcccgggttaatgagttcctacttgctttatccacactgccagacctcctaaagcacggtgattgtatcttactttctgtgtatttaaatctcatttccagagcattcataatcttatgccacattatttatttcacttattattgcctcagtttcttgtttgttgagacagggtcaagctctgtcacctgtgctggagtgcagtggtgtggtcacgaatcactgtaacctccccctcccgggctcaagtgatcctcccacctcaaccccataaatagctgggataacaggtgcatgccaccacatccagctaatttttgtatttttttggtagagatggggtttcaccaagttgctcaggctggtctcgaactcttggactcaagtaatgcacttgcctcaaactcccaaagtgctgggataacaggtgcaagccaccacacccagctaattgttctattttttggtagagatggactttcaccatgttgccaaggctcgtctcaaactcctagactcaagcaatccacctgcctcggcctctcaaagtgctgggattacatgtgcaagccgctgcacccagcctttaattgttaactaatgttagtttattgaagatgtggacaaaatacaaatatatttaaatgacccatgtcccttagcagagtcatacaccaagaaaataaatgcatagcaaatatttgttgagttgtataatttttttcctaacaggaaaatattaactttataataattatagccagaagataaataaatctaacaattagatataaaattactccttcaatttttctttttcagttatatgaaagtaaggacgcagtcagtattttccaaagggaagaatttttccttaaactacagaataatttctaaatacaaccctcagatagattatgaagacatctcctaagagagtataataaaacttggtagggaccatctattcatcgacataattttatagacccacagaggatgtaggtcaaagcttatgtctctacaggccaatacatggcagaactggggcaaaagtctgcatctaactaatatttcattcctcttttgttcagttaattcaatcatttatccgctcatcagcatttgttaggtactaaggatacaagaaaaaatgagagacctatccctctcccctaacccatccttcaaagtgcttattacgttctaatactgcggcaaagaaaaacaatgtaaataggtaaatgttatgtactacattagaaggtattaaatgctagagagaacaaaatataggatagtgaggggattaagaagtggaaatggtggggttggtcgtgacggctcatgcctgtaattccagcactttgggaagccaatggaggaggactgcttgaggccaggagttcaggaccagcctgggcgacgtggcaaaaccctgtctccacaaaaacaataataataaaaattagcctggtgtaatatcacacctgtagttccagatattcaggaggatcacttaagcccaggagagagagagagatacaagtgggagggggtactacaggcgcataccaccacgcctggctagttttttgtatttttagtagagaaggggtttcaccatgttgccaaggctggttgcaaactcttggggccaagagatctacccgccctggcctcccaaagtgccgggttgcaggcatgagccactgtgcccctgcttgaatgtttatttgaagacagaatcaaccagctatgccaatgtgcttacaagataggagggaaaagagtcagagacactgccaaggtttctagcttccacaaccagaagaatggaactcttcttcatttgttcagaggacatttgaatacacattagttttaattaaacctatttttgaaaatatgtgctcaagtgttacactgaagcaaccaacaatcatccatacactgtccattgcccccaagatatgtaagttcactatggcattcaaaaccaaacactggatcctctaatttaatactgtacctcacaccaaaaaggatgaaaacagctaaaaagaggctgagcaaataaaaagcatccaagtaggtaagagtcattcatgcaggtagcatctattgagtggctaccacgtgcaaggtagtgtgaaaacacagtaataaaataaaaacagattctaccataaggagcttatgttcatctagccttgaacagacaaagagacaaagtattatgacagtactataacagaagttgagagaaggtgatgtcagagcagaaaagagcctaactgaagagactgatgaaagtgaggctttacagaggaggtctacataattacttaacattccccaaaatatatttaatatattttgagctatacttattcattaactatacacttaatgactttgcccttttctgtatacaatgtttcatatgccacaataacacttatttcggataaagtttactcatgtttaataaccatgaaaagaaaggttagcattagctgagaaaacttcataatgttctactccacacctgtcatgctaccccaacatgggcttccctaacattccaggtttaaactgggtcagtgttgaatagctgtgccattagcctggtggcaataaacttagggctgctgtactatgaaatagcaaccggtagaagccgaagaaaaaggtcaagagtctccttttccttcgccatgtcccgagtcagagccaggatcatgcttaggctgcacaggcctagaaaactccaagagtgaagcaagcttctgctttacacaaggaccaaaggaactggaatgggtcacagttacatgcagccttaatacctcctaagtgactcctctgtggatgaaccctctctcaactgtatttgcaatacagctaacaggcaatttcacatacttccttacatcactctatcaggtcaatcttccctatgcatctcaagacaaaccagtgaccccactgcagaccagttccacaagaatcaccctgggctacctggaaaagataagttgtctaaagtgctttaaaaaaccctattaagatgagaacttcaacagctttatgaaaattttgaagagaaaggtgttataagcttctgcagttcccattcaactccttccctattcaaaagtttcaatgctcttccacctcccatcctcaataacatttccatcctcagctacagctgtgtaatctcaaagagtagtcagaagaggagattttaaaaaacaacgtaagagtcaagccagtgcttctgggaggccaaggcaaggaggatcacttgaggtcaagagtttgagaccagcctggacaacacagcgagaccccatcctttaaaataaaaaaaaccctttaacaattagctaagcatggtgggacttgcctatggtcccagctacttgtacttgcaaggctaaggtaggaggatagcttgagcccaggagtttcaggttacaaagaactatgatctggccattgcacctcagcctgggcaacagagcaagaccctgcctcttaaaaactgcttagtccctattctttcccctcatttaccaggtgtgaaatttcaacaaacatgtttcagtgaaatgatgaaaaggacacaacagcaaagtatgttagaaaaaaaatgctttggaatcagataaaaagtcctgagtttaaatttagctctgccttttacaagcctctgaagatttattctgatcattaaacgaacatacatgagtaaacctttaattagtatacactcaaggtacgtatattgttttcgtttctccttctaaagcatggaagagtttctttttaaaaaacaagctgacaaactatgaaaattaaaagagtacaacagcatgcagaagtagtacagaggagttcctagaagttatattctttctccagagagcaatattattcccaaaagggactctactcacttcacagcttggaaggtaatacctaccttctgacagaacagaaactggtgtctggatcctagaatcacctagcagtagtcacaaatactttttttttttttggtaatacgccacttaaataaaattaatgttaataagcaacaaagtaaatccttaaaaagaaaagccccaccatccctccaatctcccacccgaagacaaattataactcaacagcctatcaccaagattcagcctatcacctaggttcatctcaaaaaaaaaaaaaagacctgtgcaacccaggaagtgctgggaaatcttggtgcagcatggaaaatatgaacaccaacccacttaaccaaaacacataggaaaaactttcttccatttcagtaactaaaaaaaaaacccaagcacttaaagtgattactaacttgagcaatagctctgcactcacttggatgtgtaaccatgaacaaactacttgactgctctgatcttccattgtttatcttgaaaatcgtgaatgagagtaaaatgcttagcacagtgcctgacatatcacaagtgctcaaaaacttctattaattatagtgttacataaagactaaatgcatgtgaatatatcattgggggaaaattccatggcttgttagagcaagttgaatattgtctcttccaaatttatgttcacccagaacctgtgactatgaccttgtttagaaaaagggtctttgcagatgtaatcaagttatgaagagccatttagtgtgggctctaaattcaatatgactggtgtcctcctgacatggaaatctacacagatgcaaagagaaagatggtcatatgaagatggaggcagcaactgcagtgatgtagctacaggccaagaacaccaaggactagcacaatatcagaagctggaaaaagacaaggaaggattcttccctagagcctccatagagaccatggcccttttgacaccataatttcagacttctggcctccagaacggtgagagaacacatttctgattttttaagccatcccatttgtgatagtttgttatgacagtctaggaaactaatccatttgttgaaaaagaaatgtataaatacgacacgtaaagctgtgaattttcttgatgcattacttattggaactatcaacctagttttattcttcctatcggaactctgagaagtaaaagattatctatgatgttgtattttacagaccaagaatctgaagctcagaaatgttaagtgacttttcttctcaaggttcatgtaagcagctggtagcaaagccacgattagaaacaaaaatttaccaagtccaagtatggtgcttaatacaatacgctttgaatgatgaaactcttggataagcaacatacattcatgtgccaaatagcattatggtcaatgacagaccacatatacaatgatggtcttataagattttaatacagctgaagaatacctgttttagcacaaagcactactcctgtgtttgtggtgatgctggtgtaaagaaacctacagtgctgctattagaagtataccacatacaattatgtacactaagaatataatagctgataataaaagctatgttactgttacacttatttcttatgataataaaaagtgttatgtatttactatactatacttttaatcgttattttagagagtacttctactcattaaaagaagtgaactgtgaaacagcctccagcaggtccttctgttggcactgtcacaggcaatgaaagctccgtgtgtgttgttggccctgaaaacctaacagtgtaacaagatgtgaaggtggaagacagtaataccgacaaacctgaccccatgtgggcctacgttcatgtgtgtgtttgtgtcttagtttttagcaaaacagtttaaaaaataaaactttcattttaaaatggaaagttttaaagatagaaaaaagcttgtagaataaggtgtgaagaaaatatttttgtacaattacaatgtatttgtgttttaggctaagtgttattacaaaagagtcaaaaagttttaaaaacttaaaagtttataaagcaaaaagttatagtaagctaaggttaatttattattgaaaaaaatatttaaaataaatgtagtgtagcctcggtgtacagtatttataaagtttatagtagtgtacagtcatgtcccaggcttttcaatttcagttacccttcacccaccgactcacccagagcaacttccagtcctgcaagctccattcatggtaagtgccctatacaggtgtaccatttttatcttttctactacatttttactgtattttttctatgtttaggtatgtttaaatacataaatctttaccactaattgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatatgagacagagactcgctctgctttgcccaggctggagtgcagtgtcgcgatctcagctcactgcaccctgtctcccaggttcaagtgattctcctgtctcagcctcccgagtagctgggattacaggcacccgccaccacacctggctaatttttttgtatttttcatagagacaggggtttcaccatgttggccaggctagtctcgaactcctcacctcaggtgacccacccaccttggactcccatgcctcggcctcccaaagtgctgagattacaggcgtgagccactgcgcacggccctcagcttgaatttaagtgcactttatgatgttcacgcaccaatgaaatcacctaacaacacatttctcagtttcccttttgttaagcaatgtgtgatggtatatacaaaactccagattattttccagatatttagaaatacttttcagatattttgatattttgaaagtttctgaaaattgctctgtcattacttctgagtgatgagctgaagaataaagcatgaaccaaatgaggtgagtatcttcttatacacagctagtgagactataaactgacactgccaaaatacttctctgaagaatgcattaagaacataaaagagcattcatacctttgactgagataaagatatttatcatggcatatttaatttaaataacaaatgtaacttaaatagtcaacaaagaaagccaatagcatgcagccattaaaaatgttttccaaaaaccaactgggaaatattcagggcacatacgtaacatgactgtatttgaacaaattacttatgtgctaggaaaatgtaccataatgttggtagcgagataattttgagctgttgggttgttttttttttttttggggggggggggagggtgggtgtcttttatacttctatgtcatttcagtttcctgagaattgatacacagtatttcatcaattctaagaggtactctccccacatgtcaacaacttttaaatcaagatgcattttacaatttctgttatgccctggtttaactgaaataatttctttgtcgtacttaaaacaatggtacatcttacaatcaatagcatcttaagttctatgaaatgtagcagttttataacaaggaactaagatgatataacatatacacatatataaacccacatatatatttatgaatgtatataaaaagatgaagcagcacttatgactactattatactaatctcagttgttactaagagactctagttctcaaatatagaaaatcccacttaactactggctataaaaacctagaaacagacactgaagaggtgtctctgatagagaaagactgtgtttttctcctcagtacaggcatatccagtcacctcctagttattcttagtcatcattccagttcaagttctacaaatctcactttaaaatttcctttgtgaagacttgggaaagcaaaatatgcaccaaatctagaatgtttattagttttgttccagctaatttttaaataagtaaatcaggatttaatttgtatgctaccctaagggaacaaactagtaagaataaaaaagtgagccctctggactgtgtcctcaattaaagtatgctctattgaacttttagggggagggggaatatatatatatatatgtatctccaatctggaaagaagctataagtccgcagtgacatttttagaataaaagtttaaatgattagatagcccacagaactttcacttcaaaccctgatcattctgttcattttatcagttgatcaaccttcaacttttggcctactaatttaatggatactgttcacaggaaagccattttcttaaggctttgactagtactaaggtcaaaaaggcattttgacccttatttttagtagcaatagactttttctagacatgggtctacataaagatagagctcagccacaccaagctaatataaaaaatactttgcaagaatgtaagcttcatgaaggtaggatttttgagaacactgctgagacacagtaagcacttaaaataatggtacatcttaccatcagtagcatcttaagttctatgaaatgtggcagttttataacagggaactaacaaatataaatctaacaaatatgacagttaacatcaatggcttgcttgcattattcagtctgttttccttgtttcctgttagctcagatacccacacagttttgttctaaatacacgttcagttaaacattatattctaatagtgttttcctttttatgagacaggcctttcttagttgtccaggctggagtgtggtggcacaatcttggctcactgcaacctccacttcgtgggctcaagcgatactcccacttcagcctcctaagtagctgggactacaggcacatgctatcatgctcaactaatttttgtaatttttgtaaagacaaggtctcactatgttgcccaggctggtctcgaactcctgagctcaaatgatcctcctgccttggcctcccaaagtgctgggatcacaagagtgagccaccacgcgcagccacatcaggttcttaaattaaaccactatatcaggtcattaaaccatttactttgcaatagttaagaagagggttatgggggttacgaggtgggaggggatgtgagaaaagcgatattgatagttttcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaagacaggtggtaaacgattcttcactccaactagaaaggaaaaaatgacaacatactatgaaaaaagctatgaggcaggaaaaagcacacgtcaaggcatggagatacggatatagactaggtaattttgcaaccacataagtgaaagaaaatttgctatccaatcttcctattctctactcccaagagcctagtgcttttgtatagttttcagctcagtaaagtgcctccagatttataaaagctcaatgacaataacaaggtatctttattacaaaatagttgttaaaagtttgattcgaaaaattttaaggaaacctttcaggtaactgaaagtggagggtaggggcgcgactcatgaaggagttttttaaccaaagaaatgatatgatacatttttaaatgaccacttcagttgcaatataaaataacagattttggaggaaaatgtcaatacaaggatatcaattatcaattattaggttactatattggttcaaggagagatgatggtggctgtggagatgagtgaaatcaacagatccaagatatattttagagagtattgtagaagactaggaatgggagtgaccagacaggaatgaagacttctagacttactgcacactgtcatgaggaaggatggggatggaagggtacagtggaataagctgggttttagcagaaggaatcaagagccccattacaaacacattaaatggcctggcgtggtggctcacgcctgtactcccagcactttgggaggctgaggcaggcggatcacctgaggtcaggagtttgagaccagcctgaccaacattgagaaaccttgtctctactaaaaatacaaaactagctgagcgtggtggcaggtgcctgtaatcccagctactggggaggctgaggtgggagaatcgcttggaccctggaggtggaagttgcagtgagctgaggtcgcgccactgcactacagcctgggcaacaagaacaaaactccatctcaaaaaataaaaaataaataaaaataaacacattaaacgtttataatgtatttacaagactaacaatcagataaagtctgaacttcagaaaggagatagagctgacctgaaaatataaattacgaactattgttatatgaatgttacttaaaagacgaggaggccaggtgtggtggctcatgcctgtaatcccagcactttgggaggccgaggcaggtggatcacttgaggtcaggagttcaagaccagcctggccaacatggcgaaaccccacctctaccaaaaaaaaaatacaaaaattaatcgagcacggtggcatgcacctgtcagcccagctactcaggaggctgaggcaggagaatcacttcaatctggaaggcggaagctgcagtgagctaaggtggtgccactgcactccagcctgggcaacagagtgagactcggtctccaaaaaaaaaagggcagaagatggggcggaagaatagagataggaaagaggaggatgttgagaactaaaccctgaggtacttttagtattcaaagtgtaggggggtctggaaatcttgtagagaccagtaggggttggagtatgacatcttccaataatgaattctcgttgctgtccccttatgggtctgggtctacctgatagtctcttctggaagtcggtatcacttgtgcttaatttctactcttttgtgccctctatacagcctctactacaaatcttttttgaagaagcacagggagaaataacttggggaaaaaaaaaagcctatcttttagaaatagattctgaaatatttacagatgaaataatatgttgtacagaattggcttcaaaatagtccaagtaaggggtggtctagataaaaaaaaaaagaacagctctgagtagatgcctgttacagttgggcaatgcacacatgggaaggttcactgcactggtctctctgaatatttcacaataaaacataaaacatagtatggaaggttggcaaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaata

SEQ ID NO: 28 - DNA, 195920 bp, Homo sapiens
cccataccaccaatgtatctatgtttcctttctcacttaacaatttttaccctgattagaccattcactaaaagtttcattaataacttaaaaaagatctgtaaacagcatgcaatgaacttatattatagacttaaatagtggcaaaacttggcattctgctctttaatttattcaaaactactttccagttaagaactatcaatcttctagtgtcttcacatttatctctagcaacagtggctggctttcaaaattaggtgagagatctttccaagatctaaacatctccaatatctgcctcagagaaaatttagtttccaccacatcatgcgttcctgctaacaatgattaaaataaataaaagaactataaggttggtttatttgcggatacaagaacagcttgcttaactcaccatttaaaaagccatcacttcacactagctttattatctgaagcataatcaaaataataaactacggttgtgggactttggaatttctaattaagttatggagacttaaatcaagaaatatgaatattcataaaacccagtaaccttttaggcaaagtaaaaaagtgaaaagaacaagtgctcttggaattcagaaagaaaattaactatggtattgagagaaaccaggaaagagaaggaatcacagtagagctaggatacagaaggaaacagaaaatgacagtttaatgctcattatagaataacagtgaatcacccacagagaccattttcagtgttcttgtgaatttaacctctagtctaaccttttaatgaaaaggctataatatattagagtggcccagaaaggtgaccttatgtctcaggtgtcagagccacacccaggtctcctgattcccaatgatactccctaaagccttacttgctctggctgtagtgttttgagaattggagctgcttttaatcctatggtcagctacacagctgcaggatgggccctagattccctattcaggaattcagatcttaaaacaccaaaagtgataaaagtagatacagttccccttcttcagccaatgcaaggatcctagttacagagaaaaaacggtgtgccaagacaacacccttaattctcacgcatttccccctttctatcttttatacttaccaatttatcagtcccatgatctgtcttcacctcagaactaagtggaagaaataagtctgttgtatgctctgggggaggtacctccccaagaactatcaacccctgcaggatagagaggagaaaaatagcataagtgagcagtataaacttcaaatttaatttaggagttaagtctcaaaaggactgttggtgtactagaggccccctcttcctcaccctatggttcagaaacaaactacagcagcagcagctttgttttcccaaagagctatttcaacaagcagcagacccaggctcccctctctgccacttgactgctctgacctacatggctcatcagccatttagcatctttattcatatctttcagatatgaaatctttaccagattatggcatttataccatattactagactccactagattaacagcagcaatgcagtttttgtagccaacaaatgcagtttatgacttactaagctgaaaatgctactattcttaatcatgtactccaccaactatacctgcacaaacaaaactgaatgaaacaaatgtggaacagtcccctacaatttatgagaaaccaagagcttcttaaaagctggcccaaaggaacctgcttttttcataagcataaatattacttcagattaagttcctgcttgacaatttcaaattcagacctttggaaattcattccaggaaacaatttacataaaaagaaattaaaaatgaacccacaagtcctccccattgtacatataatgagccaggatgggtaaaggcagaaggtatcttattattaaaaaaacaaaatactacatatgaatcccaccatgtataccagaagaggtgacaaaaataaggctatgacactatataaccgaaagactgggatgcaagtgatcagggttcccaatctctttctctggtctaaaaaatagagatctaactagattaagaagctcttaatggaaatttattatcagaatcacctggggaaccttatcaaactatactggcttaggtccaacatctactcagtacctctgggggtggggccaggtagtctacctttttatgggggaagggaggcaggacatggtgggtacatggaggtgggtgtctctctcctcccccaccccgccaaccccactatgttaccgaggctgatctcaaactcctgggctccagcaatcctcccacctcagcctctggagtagctgggatgacaggtgcctaccaccatgcccagaggtggatattctactattctttaaaagctcccctggtaagtcctaaacttgtaaagttgaaaaacactagacttgattagtttgggctcaaagaacatcctaaagtatagatttgggggactagggattgtgactattagtcttagctctctaggccatacgacagactcttatgagccactaaaccagatgatccatccctggggtccttgtaactaaaaaaccaatatgaaatacaagctgcagaaaaggggaaaacattaagaaagaaaaatggaattttatttcagtttttaaaaaagaagtatgtatctctttttctcttgaagcaaaagaagcactgcctccctattctggaatatgactacacttagcctgtatcaaaaatgaattggagggtcccggaatggcggctcacacctgtaatcccagcactttgggaagctgaggcgggtggatcacctgaggtcgtcaggagttcaagatcagcctggccaacatggtgaaaccccatctctactaaaaatacaaaaattgcccaggcgtcgtggcacatgcccatagtcccagctactcggaaggctgaagaaggagaatcgcttgaactcaggaggcagaggttgcaatgagccaagatcacaccattgcacaccagcctgggcgacagaccaaggctctatctccaacaacaacaacaacaacaacaaaaatgaattggaggctgggtgtggtagatcacacctgtaatcctagcacttggggaggttgaggttaggagtgcgagaccagcctggccgacacagtgaaacaacgtctccagtaaaaatacaaaaaatagctgggcgtggtggtgagcccctgtaatcccagctacttgggaggctgaggcaggagaatcgcttgaacctgggaggtgtaggttgcagtgagccaagactgtgccattgcactccagtctgggcaacgagagcgaaactccacctcaaaattttaaaaattaaaaaaaaaaaaaaaaaaaaaaaaaagaattggagtctcctcagaaacaagagaaaggccattaactagtaagcaagaaacattaaccctagcctttaaaatgaggtttctctggttaaagaacttctgcttcaaaatattttcttccctaaatcaaaagcataaaatataccttacaaactttatcacatccaaataaaaactatttgcaaaagacagttatcttgtacaccactgccttctcaaaacgttgtattcaacagatattccctacttaagggcccaaactgtcttcctgcttcctgtacaaagcatgccaaaaatcattttattattcaaattttcccataaccggttcctaagaacttttttaaagatcaatttccaactactttccccaaatatttgttagtgttataccaatctcatcatctcctagacaaatgtttcaatgaatgtgaagctgttgctgctgctggaggtaagggttattagtcagtagaaggttaaaaaaaactgaattaaaggttaacacatgagctgttcatctttatttatactcatttttatattttatcagtccaaattgccgttcgtccttccaaagagattttcaacaagtcccacctccttccaagaaaatgtcccgggttaatgagttcctacttgctttatccacactgccagacctcctaaagcacggtgattgtatcttactttctgtgtatttaaatctcatttccagagcattcataatcttatgccacattatttatttcacttattattgcctcagtttcttgtttgttgagacagggtcaagctctgtcacctgtgctggagtgcagtggtgtggtcacgaatcactgtaacctccccctcccgggctcaagtgatcctcccacctcaaccccataaatagctgggataacaggtgcatgccaccacatccagctaatttttgtatttttttggtagagatggggtttcaccaagttgctcaggctggtctcgaactcttggactcaagtaatgcacttgcctcaaactcccaaagtgctgggataacaggtgcaagccaccacacccagctaattgttctattttttggtagagatggactttcaccatgttgccaaggctcgtctcaaactcctagactcaagcaatccacctgcctcggcctctcaaagtgctgggattacatgtgcaagccgctgcacccagcctttaattgttaactaatgttagtttattgaagatgtggacaaaatacaaatatatttaaatgacccatgtcccttagcagagtcatacaccaagaaaataaatgcatagcaaatatttgttgagttgtataatttttttcctaacaggaaaatattaactttataataattatagccagaagataaataaatctaacaattagatataaaattactccttcaatttttctttttcagttatatgaaagtaaggacgcagtcagtattttccaaagggaagaatttttccttaaactacagaataatttctaaatacaaccctcagatagattatgaagacatctcctaagagagtataataaaacttggtagggaccatctattcatcgacataattttatagacccacagaggatgtaggtcaaagcttatgtctctacaggccaatacatggcagaactggggcaaaagtctgcatctaactaatatttcattcctcttttgttcagttaattcaatcatttatccgctcatcagcatttgttaggtactaaggatacaagaaaaaatgagagacctatccctctcccctaacccatccttcaaagtgcttattacgttctaatactgcggcaaagaaaaacaatgtaaataggtaaatgttatgtactacattagaaggtattaaatgctagagagaacaaaatataggatagtgaggggattaagaagtggaaatggtggggttggtcgtgacggctcatgcctgtaattccagcactttgggaagccaatggaggaggactgcttgaggccaggagttcaggaccagcctgggcgacgtggcaaaaccctgtctccacaaaaacaataataataaaaattagcctggtgtaatatcacacctgtagttccagatattcaggaggatcacttaagcccaggagagagagagagatacaagtgggagggggtactacaggcgcataccaccacgcctggctagttttttgtatttttagtagagaaggggtttcaccatgttgccaaggctggttgcaaactcttggggccaagagatctacccgccctggcctcccaaagtgccgggttgcaggcatgagccactgtgcccctgcttgaatgtttatttgaagacagaatcaaccagctatgccaatgtgcttacaagataggagggaaaagagtcagagacactgccaaggtttctagcttccacaaccagaagaatggaactcttcttcatttgttcagaggacatttgaatacacattagttttaattaaacctatttttgaaaatatgtgctcaagtgttacactgaagcaaccaacaatcatccatacactgtccattgcccccaagatatgtaagttcactatggcattcaaaaccaaacactggatcctctaatttaatactgtacctcacaccaaaaaggatgaaaacagctaaaaagaggctgagcaaataaaaagcatccaagtaggtaagagtcattcatgcaggtagcatctattgagtggctaccacgtgcaaggtagtgtgaaaacacagtaataaaataaaaacagattctaccataaggagcttatgttcatctagccttgaacagacaaagagacaaagtattatgacagtactataacagaagttgagagaaggtgatgtcagagcagaaaagagcctaactgaagagactgatgaaagtgaggctttacagaggaggtctacataattacttaacattccccaaaatatatttaatatattttgagctatacttattcattaactatacacttaatgactttgcccttttctgtatacaatgtttcatatgccacaataacacttatttcggataaagtttactcatgtttaataaccatgaaaagaaaggttagcattagctgagaaaacttcataatgttctactccacacctgtcatgctaccccaacatgggcttccctaacattccaggtttaaactgggtcagtgttgaatagctgtgccattagcctggtggcaataaacttagggctgctgtactatgaaatagcaaccggtagaagccgaagaaaaaggtcaagagtctccttttccttcgccatgtcccgagtcagagccaggatcatgcttaggctgcacaggcctagaaaactccaagagtgaagcaagcttctgctttacacaaggaccaaaggaactggaatgggtcacagttacatgcagccttaatacctcctaagtgactcctctgtggatgaaccctctctcaactgtatttgcaatacagctaacaggcaatttcacatacttccttacatcactctatcaggtcaatcttccctatgcatctcaagacaaaccagtgaccccactgcagaccagttccacaagaatcaccctgggctacctggaaaagataagttgtctaaagtgctttaaaaaaccctattaagatgagaacttcaacagctttatgaaaattttgaagagaaaggtgttataagcttctgcagttcccattcaactccttccctattcaaaagtttcaatgctcttccacctcccatcctcaataacatttccatcctcagctacagctgtgtaatctcaaagagtagtcagaagaggagattttaaaaaacaacgtaagagtcaagccagtgcttctgggaggccaaggcaaggaggatcacttgaggtcaagagtttgagaccagcctggacaacacagcgagaccccatcctttaaaataaaaaaaaccctttaacaattagctaagcatggtgggacttgcctatggtcccagctacttgtacttgcaaggctaaggtaggaggatagcttgagcccaggagtttcaggttacaaagaactatgatctggccattgcacctcagcctgggcaacagagcaagaccctgcctcttaaaaactgcttagtccctattctttcccctcatttaccaggtgtgaaatttcaacaaacatgtttcagtgaaatgatgaaaaggacacaacagcaaagtatgttagaaaaaaaatgctttggaatcagataaaaagtcctgagtttaaatttagctctgccttttacaagcctctgaagatttattctgatcattaaacgaacatacatgagtaaacctttaattagtatacactcaaggtacgtatattgttttcgtttctccttctaaagcatggaagagtttctttttaaaaaacaagctgacaaactatgaaaattaaaagagtacaacagcatgcagaagtagtacagaggagttcctagaagttatattctttctccagagagcaatattattcccaaaagggactctactcacttcacagcttggaaggtaatacctaccttctgacagaacagaaactggtgtctggatcctagaatcacctagcagtagtcacaaatactttttttttttttggtaatacgccacttaaataaaattaatgttaataagcaacaaagtaaatccttaaaaagaaaagccccaccatccctccaatctcccacccgaagacaaattataactcaacagcctatcaccaagattcagcctatcacctaggttcatctcaaaaaaaaaaaaaagacctgtgcaacccaggaagtgctgggaaatcttggtgcagcatggaaaatatgaacaccaacccacttaaccaaaacacataggaaaaactttcttccatttcagtaactaaaaaaaaaacccaagcacttaaagtgattactaacttgagcaatagctctgcactcacttggatgtgtaaccatgaacaaactacttgactgctctgatcttccattgtttatcttgaaaatcgtgaatgagagtaaaatgcttagcacagtgcctgacatatcacaagtgctcaaaaacttctattaattatagtgttacataaagactaaatgcatgtgaatatatcattgggggaaaattccatggcttgttagagcaagttgaatattgtctcttccaaatttatgttcacccagaacctgtgactatgaccttgtttagaaaaagggtctttgcagatgtaatcaagttatgaagagccatttagtgtgggctctaaattcaatatgactggtgtcctcctgacatggaaatctacacagatgcaaagagaaagatggtcatatgaagatggaggcagcaactgcagtgatgtagctacaggccaagaacaccaaggactagcacaatatcagaagctggaaaaagacaaggaaggattcttccctagagcctccatagagaccatggcccttttgacaccataatttcagacttctggcctccagaacggtgagagaacacatttctgattttttaagccatcccatttgtgatagtttgttatgacagtctaggaaactaatccatttgttgaaaaagaaatgtataaatacgacacgtaaagctgtgaattttcttgatgcattacttattggaactatcaacctagttttattcttcctatcggaactctgagaagtaaaagattatctatgatgttgtattttacagaccaagaatctgaagctcagaaatgttaagtgacttttcttctcaaggttcatgtaagcagctggtagcaaagccacgattagaaacaaaaatttaccaagtccaagtatggtgcttaatacaatacgctttgaatgatgaaactcttggataagcaacatacattcatgtgccaaatagcattatggtcaatgacagaccacatatacaatgatggtcttataagattttaatacagctgaagaatacctgttttagcacaaagcactactcctgtgtttgtggtgatgctggtgtaaagaaacctacagtgctgctattagaagtataccacatacaattatgtacactaagaatataatagctgataataaaagctatgttactgttacacttatttcttatgataataaaaagtgttatgtatttactatactatacttttaatcgttattttagagagtacttctactcattaaaagaagtgaactgtgaaacagcctccagcaggtccttctgttggcactgtcacaggcaatgaaagctccgtgtgtgttgttggccctgaaaacctaacagtgtaacaagatgtgaaggtggaagacagtaataccgacaaacctgaccccatgtgggcctacgttcatgtgtgtgtttgtgtcttagtttttagcaaaacagtttaaaaaataaaactttcattttaaaatggaaagttttaaagatagaaaaaagcttgtagaataaggtgtgaagaaaatatttttgtacaattacaatgtatttgtgttttaggctaagtgttattacaaaagagtcaaaaagttttaaaaacttaaaagtttataaagcaaaaagttatagtaagctaaggttaatttattattgaaaaaaatatttaaaataaatgtagtgtagcctcggtgtacagtatttataaagtttatagtagtgtacagtcatgtcccaggcttttcaatttcagttacccttcacccaccgactcacccagagcaacttccagtcctgcaagctccattcatggtaagtgccctatacaggtgtaccatttttatcttttctactacatttttactgtattttttctatgtttaggtatgtttaaatacataaatctttaccactaattgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatatgagacagagactcgctctgctttgcccaggctggagtgcagtgtcgcgatctcagctcactgcaccctgtctcccaggttcaagtgattctcctgtctcagcctcccgagtagctgggattacaggcacccgccaccacacctggctaatttttttgtatttttcatagagacaggggtttcaccatgttggccaggctagtctcgaactcctcacctcaggtgacccacccaccttggactcccatgcctcggcctcccaaagtgctgagattacaggcgtgagccactgcgcacggccctcagcttgaatttaagtgcactttatgatgttcacgcaccaatgaaatcacctaacaacacatttctcagtttcccttttgttaagcaatgtgtgatggtatatacaaaactccagattattttccagatatttagaaatacttttcagatattttgatattttgaaagtttctgaaaattgctctgtcattacttctgagtgatgagctgaagaataaagcatgaaccaaatgaggtgagtatcttcttatacacagctagtgagactataaactgacactgccaaaatacttctctgaagaatgcattaagaacataaaagagcattcatacctttgactgagataaagatatttatcatggcatatttaatttaaataacaaatgtaacttaaatagtcaacaaagaaagccaatagcatgcagccattaaaaatgttttccaaaaaccaactgggaaatattcagggcacatacgtaacatgactgtatttgaacaaattacttatgtgctaggaaaatgtaccataatgttggtagcgagataattttgagctgttgggttgttttttttttttttggggggggggggagggtgggtgtcttttatacttctatgtcatttcagtttcctgagaattgatacacagtatttcatcaattctaagaggtactctccccacatgtcaacaacttttaaatcaagatgcattttacaatttctgttatgccctggtttaactgaaataatttctttgtcgtacttaaaacaatggtacatcttacaatcaatagcatcttaagttctatgaaatgtagcagttttataacaaggaactaagatgatataacatatacacatatataaacccacatatatatttatgaatgtatataaaaagatgaagcagcacttatgactactattatactaatctcagttgttactaagagactctagttctcaaatatagaaaatcccacttaactactggctataaaaacctagaaacagacactgaagaggtgtctctgatagagaaagactgtgtttttctcctcagtacaggcatatccagtcacctcctagttattcttagtcatcattccagttcaagttctacaaatctcactttaaaatttcctttgtgaagacttgggaaagcaaaatatgcaccaaatctagaatgtttattagttttgttccagctaatttttaaataagtaaatcaggatttaatttgtatgctaccctaagggaacaaactagtaagaataaaaaagtgagccctctggactgtgtcctcaattaaagtatgctctattgaacttttagggggagggggaatatatatatatatatgtatctccaatctggaaagaagctataagtccgcagtgacatttttagaataaaagtttaaatgattagatagcccacagaactttcacttcaaaccctgatcattctgttcattttatcagttgatcaaccttcaacttttggcctactaatttaatggatactgttcacaggaaagccattttcttaaggctttgactagtactaaggtcaaaaaggcattttgacccttatttttagtagcaatagactttttctagacatgggtctacataaagatagagctcagccacaccaagctaatataaaaaatactttgcaagaatgtaagcttcatgaaggtaggatttttgagaacactgctgagacacagtaagcacttaaaataatggtacatcttaccatcagtagcatcttaagttctatgaaatgtggcagttttataacagggaactaacaaatataaatctaacaaatatgacagttaacatcaatggcttgcttgcattattcagtctgttttccttgtttcctgttagctcagatacccacacagttttgttctaaatacacgttcagttaaacattatattctaatagtgttttcctttttatgagacaggcctttcttagttgtccaggctggagtgtggtggcacaatcttggctcactgcaacctccacttcgtgggctcaagcgatactcccacttcagcctcctaagtagctgggactacaggcacatgctatcatgctcaactaatttttgtaatttttgtaaagacaaggtctcactatgttgcccaggctggtctcgaactcctgagctcaaatgatcctcctgccttggcctcccaaagtgctgggatcacaagagtgagccaccacgcgcagccacatcaggttcttaaattaaaccactatatcaggtcattaaaccatttactttgcaatagttaagaagagggttatgggggttacgaggtgggaggggatgtgagaaaagcgatattgatagttttcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaagacaggtggtaaacgattcttcactccaactagaaaggaaaaaatgacaacatactatgaaaaaagctatgaggcaggaaaaagcacacgtcaaggcatggagatacggatatagactaggtaattttgcaaccacataagtgaaagaaaatttgctatccaatcttcctattctctactcccaagagcctagtgcttttgtatagttttcagctcagtaaagtgcctccagatttataaaagctcaatgacaataacaaggtatctttattacaaaatagttgttaaaagtttgattcgaaaaattttaaggaaacctttcaggtaactgaaagtggagggtaggggcgcgactcatgaaggagttttttaaccaaagaaatgatatgatacatttttaaatgaccacttcagttgcaatataaaataacagattttggaggaaaatgtcaatacaaggatatcaattatcaattattaggttactatattggttcaaggagagatgatggtggctgtggagatgagtgaaatcaacagatccaagatatattttagagagtattgtagaagactaggaatgggagtgaccagacaggaatgaagacttctagacttactgcacactgtcatgaggaaggatggggatggaagggtacagtggaataagctgggttttagcagaaggaatcaagagccccattacaaacacattaaatggcctggcgtggtggctcacgcctgtactcccagcactttgggaggctgaggcaggcggatcacctgaggtcaggagtttgagaccagcctgaccaacattgagaaaccttgtctctactaaaaatacaaaactagctgagcgtggtggcaggtgcctgtaatcccagctactggggaggctgaggtgggagaatcgcttggaccctggaggtggaagttgcagtgagctgaggtcgcgccactgcactacagcctgggcaacaagaacaaaactccatctcaaaaaataaaaaataaataaaaataaacacattaaacgtttataatgtatttacaagactaacaatcagataaagtctgaacttcagaaaggagatagagctgacctgaaaatataaattacgaactattgttatatgaatgttacttaaaagacgaggaggccaggtgtggtggctcatgcctgtaatcccagcactttgggaggccgaggcaggtggatcacttgaggtcaggagttcaagaccagcctggccaacatggcgaaaccccacctctaccaaaaaaaaaatacaaaaattaatcgagcacggtggcatgcacctgtcagcccagctactcaggaggctgaggcaggagaatcacttcaatctggaaggcggaagctgcagtgagctaaggtggtgccactgcactccagcctgggcaacagagtgagactcggtctccaaaaaaaaaagggcagaagatggggcggaagaatagagataggaaagaggaggatgttgagaactaaaccctgaggtacttttagtattcaaagtgtaggggggtctggaaatcttgtagagaccagtaggggttggagtatgacatcttccaataatgaattctcgttgctgtccccttatgggtctgggtctacctgatagtctcttctggaagtcggtatcacttgtgcttaatttctactcttttgtgccctctatacagcctctactacaaatcttttttgaagaagcacagggagaaataacttggggaaaaaaaaaagcctatcttttagaaatagattctgaaatatttacagatgaaataatatgttgtacagaattggcttcaaaatagtccaagtaaggggtggtctagataaaaaaaaaaagaacagctctgagtagatgcctgttacagttgggcaatgcacacatgggaaggttcactgcactggtctctctgaatatttcacaataaaacataaaacatagtatggaaggttggcaaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcgtagcccgggcggattcagccccacaaaatgggcgcagtttgcaaacagccccccggcctgggcgccgagggccagcggcgggcgggggcgcgcgacggcggctccggcccgggcccgccgctctcctccccccgacgcccggagccgccctgactttccgggcgggggggcgaggcagagggggaggggaaggcggcggcggggagcggctgctttttcttctctttcgggccctttcccggccttgctccgcaccgacggggcccgagcacggctggagaccgcagcccggccgggagggcgggcgggcgggggcagagagtgaaaccgcccccccgccccgcacaaacaagcaccgccgtctgcagcccgaacccgcacccaggccgccacccccggccgcctctttccagccggggagcgcgcttcagccgccccccgcgccgccgcggcgagacgagtcggcttcgctacggtgctcggttctcccgccggctcggcgagcggtggcggcggtggcggcggcactgggaaaatggcggccgagctccttttccctccccccctttaatctgaagcggagggagaatggagcgagcgagcaagcgggcgagcgccggggacacggggaggagggacagcagcgcctccgccggctgcggctgcggcggcgaagggccgctccaccccggcgcgccgccagggggcgcccgccgcgccgcccccgcgggccgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggtgagtctaacctgaggcactgacgccgtcacatgccctccgtgctggggccggcggtgcggctcgccagttgaggggcagggcgggccggcgccgcggagcgagaggacgtgagcgaggaactgtttgcactgtgtagtaaagagggtaaggccgtcggcaccacactattccaaggctaaccctgcagaaagctccctgaccagtgaagcggcttccgccgcccgccctttgtccctagcagccagcctccgtatactgcagcacggctgggcactagccccagcaccgcgctccgcagccaccagagttgggcggggtggggagggtgcacgtagtcactgcgcaggccccagccagggcccgcgccgggccagcccgggaagggacagccgggagccagaggggaagtgatggccccgccggcgccgggcccgctgggaactgtagttttcgtgaagaaacacgcgtcttgttttgggtgtcatggcttggcagatccgccaaaacaggcaaatggcattacacaatgagtatttatgcttcctgccgccaccaaaaggaagttcactgccatgctaaaagtttaacaaagaactccataaagaaacacaagtctcacaacaaaaagccaacttcccacctcgttaccagagttggtttaaagtggtggcaccttatcatttctcatgaccagtttatcagtacagaactttatattgtccccaaaataggacctttaaaataatggaacctttcctagacttaaagaattcataaacataatgtaatacaaagtgtcacacaaagtgtaattctaccaccctttaaagttgccaaaagatgagtggagtatcttgagatttaaaagactaatctaggattcatcaaaactggcttaaatgactgaagaaaaaatcgttcaaatcattaaatcatcaaattcggcagataagaagggtatgtatgctctactaccaaaaaggaagacgcaaaatgcttcacacttttttgtggcttaccagaaccaatatccggcattatacgtcacttctgcttatcaaaaaacaccctcacagtcgttacagaacggttttagtcttcccacaaagttacactaactcacctgcccctgcaacatctgcacctaggtttctgcgaatttccatttgtactcctaaaatcacactctcaagcatagtcatagttctcaaataccaaaggcaggcagtttggagtcatagggtcaaattacacaaagaataaactaatatttgtatacacatccaaaagaggtctttagtcttggatttttaatttacaaccctggggaaaaactttgacttttttattgtacacacatacacacataaatagtaattccacaaaatacagtagaagggtattggaccaacagatggcgaactagagccccaatctgaggctcctgaaatctaaattagcagaatgaaaaataccaaataaggcaaagccctttgcagcgtatacttaaatattaaattcagacacaccataacaaaataatcttactgctgctccaaatttttaagactgaactgtcagatttaattaggcaaccaaataagcaagattatatgaaatatatttttctaatggattaggagaaaactggaaaatgctcatttttaaaaccatgtatttgggggaactataaattccagtttcccctttctctcattgcttagtgcaagagtcaagagttcacagggtttatggcacttaaatcagtcaacctgttgtatattcttatctaaaatcagacatctttcttattaggcatccacttgtacttttatttttttgacagggtcctgctcggttgcccaggctagagtgcagtggtgcaatcaaactcactgcagcctcccaggctcaggcgatcctacctcagcctcttgagtagctggcactacaggcatatgccaccatgcccagctgttatttttttcactcctttttgttttggtagatacagagtctccctatgttgcccaggctggtctcgaactcctggactcgagtgctggcattacaggcatgagccaccacacaaaaatcttatgaagagaaacaaattttcttaaatttccccccaaaaaatagtggatgtccaaaaggctgattgaaaacacctacatacaaaataaaacaaacaaacaaaaaaagatttaaagaaaaaggcctggtgcagcagctcactcctgtaatcccagcactttgggagggtgaggtgggaggatcacttgagctccggagttagagaccagcctgggcaacagagtgagaccctatctctacaaacaaaattttaaattagccaagtgtggtagcatgtgcttacagtcccagctactccagaagctgaggggattgcttgagcctgggaggtcaaggctgcagtgagtcatgatcatgccattgtagtccaacctgggcaacagagcgagaccatctcaaaatgaaaagtgataaaaaaataaaaacaccaacatatttcaaatcactcttggaatagtcatgttgactctccaatatccactctattctgattagttttaacccattctctttgccaatgattggttaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagcctgaagatgccaccaacatcaaagggaatagagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaatgattgagttctaatgttttttagtatttgtatcttactttatgattacagtattttatataactaatcttattatttcttcctcagaaaagacattccatggccaggcatggtggctcacacctataatcccagcactttgagaggccaatgtgagagtattgcttgagcccaggagtttgagaacagcccagggaaaacagcaaaacttcatctcttcaaaaaataaataataaaaaaatttagccgggggtggtggcatacacctgtagtccaagctactcagaggctcaggcaggaggatcacttgagcccaggaggtcaaggctgcagtgaaccatgatcacgccactgcaaaccagcctgggcaacagagcaacaccccgtctccaaaaaaagaaaaagaaaggaagggaggaaggaaagaaagaaaaaaggaaaaggtgttccctcttacacacagctctgtatccatccatctttgtctgtgttctctctacctagaaaaagaggaccatccctcattaccaccattccttgttaattcctctctccaatccacctacaactcatgttatcctcttatattccaccacaccactgttatcgtctactcacttcacttgacaataatgtaggctgggcgtggtggctcatgcctgtaatcccagcactctggaaggccaaggcaggcagatcacctgaggccaggaattcgagaccagcctggccaacatggtgaaaccccgcctctactaaaaatacaaaaagtagccaagcatggtggtgcacgcctgtagttccagctactcgggaggctgaggcatgagaatcacttgagcccggaaggcagaggttgcagtgagccaagatcacaccactgcactccagcctacgcgacagaaggagactgtgtctcaaaaaaagaaccaataatgtacagagttggcactacattacccttggttaaatgctgtctgtaattcctctgagtttgttttcatataccagtcttgccacctcaagccagcctgaaagcccttgcaggcaggaactgtggttgttctaatttaagatctgtaactcatctatagataataaacgtattccaaaaaggcactctctaccttccctgccacagaccttctaaacaagccagaaattcctaaacagaataatctcacaaattcagtacctcgtatgtccaaactaatctcaaaaggacaatgaataactttttttgcacttaagaaaaagcaattattatatattaactcaggacaagttctaaagcctaggccatttagtttcaaaagcacaggggcccatttttttggttacttacctaggacctagcccagggcctggcacaaaagagacacatcataagaactgactgaataaatgaaaaaggtagagtgtagtacttaagcacacaggacctaggtagcccgattctaatcctgcctccctcacttattctttgtgttactttgggcaaagtacgtattctgctctgtaaaatggagatagtaataccacctacctcttaagtttaactattattattagtgaatgaagctattttccacagttctaaactttaaaggttaaaatctgagtgaagcaaaaatcagcacctctttcctaattcaaacttcaaacacctatctacttaggacttggacctactttaattaaaaaaaaaaaaaaaaaaaaaaaaaaagcctggatgtggtgactcacacctgtaattctagcactttgggagaccgaagcaagtggatcacctgaggcctggagtctgagaccagcctgggcaacatggtgaaaccctgtctcaactaaaaatacaaaaattagcctggcattgtggcacatgcctatagtcctagctacttgggaggctgaggcaggagaatcgcttgaacccacaaggtggaggatgcagtgagccaagatcgcaccactgcactccaacctgagtgacagagcgggactctgtttcaaaaacaaaatccctgtctagactctagcaaacaatgttttcattcatgaacttagataacactatatataaaaatacttttagctccctaaaaacatattctgagaatgattatttacaatcataaatctaatgccacattaaatacttcaaatacatttaattcaacaaaaatctagtgagtacctattaagctcaagaatttattctagatatcacagaaatgaacacataaacctatgtaaaaacccatattaaaattataaaagaaacatctttaagctgaaactgaggcatgttctcacattaatatttaaccagctaaatattaaatagccagagtcaactaaaccaaagttaagaaatttaagtcaaaaaatttaggatgtagaaggaatatgttcagccgccacattttattagtgtgaaaatgaggccaacagaaagaagccagttaagagattgccaaagcgtcaaagctggaatcagggtctctcagtcttcaattctcacttttcccacttctaattcaccagtgctactcaattggtgaactggatgtgcaaacatgctaaaggcattaaacctaaaccatactacctatttcacagtgtcacaagtataaagatttagccaaatgcaagtagaagaaaatcctcatactgattacaatgactacaaagctcagaaatcaagattttttttcattaaatggaggccttagctgattcaaaatatcatacagtatttttatgtactgactgaatccagtagaaacaaactttcagtaagattaaacaaaagcatttcataaatggcaaagtattacaagaatgcatagcattccttcatttcaatccaacctaacaagatattttcctcctcatactactgatacaaactgcaggatttacataaagatattattttgccatctcaccacagaactgacccaataattcatacaaaagaaaaactaattattaggcagcctcctaatttaactgtgttagtaatgagaacaatactgttgtaggttaaacctaaatgtactagtaagtctagaaataatttactttaggataattcagaagacaacattaaagctcagctgaatacaattatatcactgaaagaaacaagtcaggttctctcaggccatcagctattgttaaaatctaacacccaagattgttggtcttctccacagtggtggatttaatagcagctaccagcactcatttctagtgcaagcagtttaagcaggattttatacgaacattttaataaagttcctcaatgagtttacacacacacacacacacacacacacaccctgattattttggtgaattttagttaattctaatgtttttaactttagaatattttaaaattctcaaataactagaatgtgtgaacgttcaatgaccaaacatagaaggagtattctaatatactgattttgcagattaagcaatctacgcaggacccaaactttttatcagataataaagctgagtgtcagaatttggccaaaatgtaccaagaaactacctgagttcttttccaaaggaaacataaaggtaaatatgcagaacttcaaggcagctgtgagcagccaagttgtggagggcctgacaaaagtgagtcagaagggaaaatgttcaaagagaaaaggaggcagcaggtgtacaaggcaaaacacaccttaaaaaatatctttacaggctgggtgcggtagctcatgcctgtaatcccagcactttgggaggccaaggtgggcagatcacgagatccggagatcgagaccatcctggccaacgtggtgaaactccgtctctactaaaaatacaaaaaattagctgggcatggtggggggcacccgtagtcccagctactcgggaggctgaggcagcagaatggcatgaacctgggaggcggagcttgcagcgagcggagatcacgccagtgcactccagcctgggcgacagagcgaaactctgtctcaaaatatatatatatatatatttttctttttacgtcagttgctgattctaagttatgatgcaacttgtaaaatcttgttctgatggcatggcaaacctagggactttggaagatggcagacctgtttcctccaatgaagcagcataccattcttggaaagggaattactttttttttttttgagacacagtctcactctgctgcccaggctgccaggctggagtgcatggcaaaatctgggctcaccgcaacctccacctcctgggttcaagcgattctcctacctcagctgcccaagtaggtgggactacaggcgcgtaccaccatgcccggctaatctttgtatttttagtagagacggagtttcgccatgttggtcaggctggtctcaaaatcctgacctcaggtgatccgcccatctcagcctcccaaagtactgggattacaggcgtgagccaccacgcccagcctagaacattatttttaacccactaattcttggattcttgaacttgtttctatgtacactcaggaacatacagctacaaacggggagtaaccaaagccactgaatatatgcaggagcaacttttttggagtatcaatttaatcaaggattatagtaaaatcagatatacttttgttaaaataaacacaaatatattacaggttgaccatccctaatctgaaaattcaaaaccctccaaaatctgaaactttttgagtgccaacatgacacctcaaatggaaaattccacacgtgacacctttgcttctgatggttctctgaaccatcagaaacactgtttatttcaagaacaaaattattttaaattttgtataaaactggtcggttgtggtagctcatgcctgtaatcctaacactttgggagaccaagatgggaggatcatttgagccctggagttcaaaaccagcctgggcaacatagtgagaccctatctctgaaaaaaaaaaaaaaattaagtccaggtacagtggctcaggcctgtaatcccaacactggaaagccatggcaggtgaatcacttgagctctggagttcaagaccggcctgggcaatgtagcaaaacctatctctaccaaaaacacaaaaaattagccaggcatggtggcatgcacctgtagtcccagctacacaggaagccaaggtgggagaatcacttgagcctggaaggtggaggctacagtgagcagagatggcgctactgcactccaacctgagtaacagaatcagaccccatctcaaacaaacaaaaaaattagctgggcttggcaccgtgcatctgtaccagttagtaccagctacctgggaggctgaggcaggagaatgacttgagcccaggagttctaggctgctgtgagctaggatcacattactgcactccagcctgggcaacagtatgagacatcatctcttaaagaaaaaggtaaaaaaaagaaattatcttcaggctatgtgcataatgtgtacatgaaacatagaatttcatgtttagatttggatcccatctccaagatagtacattatgtacatgcaaacatcccaaaatctgaaaaatctgaaatccaaaaaacttctggtcccaagcatttcggataagggatattcaatgtatacagagcaaaaggcagaattctcactgtttcaagatagaaaaggagtcctcagagagatatgtcctgcttgtaacaaacagctccaaacagccctagaccctgaaaagtactttaaggaaagataaagaggtactggtttagaccatttatagataaatatgcatggctaaaacccctgaatgtaatccttccaggcagaagataaaacctgaaatctaacgtataaattgtcatgggtacaatattataaaagagaccataagttaccgagaacatgactggaattcaggaaatgctaaaggtcctgtcttatctctgtaactcatttacaaagaaatcatgtatgattttctcaactgcaatcttttttgtttctgaattagactgacaaaaattatagaatataatattcaatattttccaccatattccaaattctcactatcacatttaaacacaattttatctaatgaaatgtgtcccaaatgaaccaactttaaccagcatcagaaaaaataaaataaaatagttaaatgaaactgtatcttctttggtataagaagtccttcaggccagacgtggtggctcacatctctaatactagcactttgggaggccgaggccagtggtttgctagaactcaggagttcgagaccagcctgggcaacatggtgaaaacccgtctctactaaaatacaaaaaattagccaggcgtggtggcatgcgcctgtagtcccagctactcgggaggctgaagcaggagaattgcttgaacccagcgggaggtagaggttgcagtgtcagtgagctgagatcgcgccactgcactccagcctgaacgacagagcagactccgtctcaaaaaaaaagaaagaaatccttcagcacagagggtaggaaaaaacaactactcacacttcccagaatacctaccgtggcaataccaaaatatgaccatgcttgttaatatttgggctacggcattaaatgtttataacataacacaaacacttgtaatccaaatgtgaatgattatcttcaattttcagtaaaataagaccctataaaagccctaccattaatacatattcattcataaacatactgagtaccagtggatgttaaacactgtagaatctctaaggaaagaatactcggtcactttataagctatgtggtagtcaagaaaaatcctttctactcattgatacgttaaatgatcaaaaaatccaaagctaaaaaatgatcagagaacaatgaaaaaattttagtggctttatgcttccaattccattttcttctggactcttttctgaagcttgcctaaatcatcccaggaatgctaaaattgggtgttatttatggcataaccaaaatgaaataacaaagtaagtaccccaaataaaactaggagaaaaaatccagggaaccaagcaggcagtaaggatctaaagttctatacttggaacctctaccctgaatgttaaataatagatgttttttaaatagttgactaccaagtgtggtggcatgtgcctgtaatcctagctacttgggaggctgaggtggagagactacttgagcctaggagttctagactagtctggacaaatagcaagaccctgtctcacgggtaggggagcaggggaaggcaaccaagctgggtgtgccatgtgcctctagtcccagctacttgggaggctgagacaggaggagtgcttgaaaccataggccactgtactccagcctaggcaacataggaagaccctatctctaaaacaaacataaacaaaaaggccgggtgtggtggctcacacctgtaatcccagcacttgaggaggctgagttgggaggatcacttgaggtcaggagttcgagaccagcctggccaacatgataaaatttttgtatctttagtctctactaaaaacaaaaattagctgagtgtggtggcaggggcctgtaatcctagctacttgggaggctgaggcataagaatcatttgaacctgggaagtggaggttgcagtgagcggagatcacaccactgcactccagcctgggtaacagagcaagactctatctcaaaaaaacaaacagttatatctttaattattatcttcattcagtaattaggcaattagaatttacaattgctaaatgaatgttcaaagttcaaccaaaattagtccaagatgaagccaagaacacatctcaactcattcaataaagccattattactctgatgccaaaaccagacatagatatcacaagacaactacagaccaatatatcttatgaatacagatgtaaaagtcctcaacaaagcaaaatgaatccagcaacatattaaaaggcttatacaccattgctaagtatgacttaatcccagggattcaaggttggcttaacttctgaaaatcaattaatgtaatacaccatattaataaaggatacaaaccacatgatcatttgaatagatgcagaaaaagcacttaacaaaatccaacatgctttcatgataaaaacactcaacaaagtagaaattgaagaaaacatcttcaatctaataaaaaatacctatgggggaaaaaaagaatacctacaaaaaccccatagctaaaatcatacttaatggagaaagcctgaatgctttctccctcaggtcaagaacaaaacaaggatatccactcttaccactctgtttaacactgcactgaaggttatggccagggcaaataggcaagaaaaagaaataaaaatcactcaggcttaaaaaaaagaaggaaaactacctttatttgcagatgatataatcttgtatatagaaaatcctaagaaaatcccacaaataaactattagagccaataaacacatccaacacagttacaggatacaagctcaatatacaagtagtaatcgtatttctatacacaagcaataagcaatctgaacatgaaaagtttttaaaaattccacttacaatagcatccccccgccaaaaaaaaaagacttagaaagccaagcacgatggctcacacctgtaatcccagcactttgggaggccgaggcaggcggatcacttgaggtcaggagttcaagactagcctagccaacgtggtgaaaccccgtctctactaaaatataaaaattagttgggtgtggtggcaggtgcctgtaatcccagctactcaggaggctgaggcagtggaatcacttgaacccaggaggcggaggttgcaatgagccgagatcacaccactgtactttagcctaggtgacagaatgagacactgtctcaaaaaaaaaaaaaaaaaagacttagaaataaatttaacaaaagcagtgacaatcttatactctgagatatataaaaattacaaaagaagttacagaaatcctaactaaatggaaaggccaggtgtgatggctcacacctgtaatcccagcactttggtagactgaagtgggtgggctgcttgagcgcagaagttcaggatcagactaggcaacatggcaagaactcatctctacaaaaatacaaaaatgagctagatgtggtggcatgcacctgtaatcctagctgcttggggggctgaggagggaagatcacttgagcctagtaggttacagctgcagtgagccatgattgcattactgtacttcactgcagcctggatgacagaacaagactgtgtcccccaaaaaaaaaaaaaaaaaaaaaaggaaagatatcccatgttcatggatgagaatggatcagaagatacaactctgttaaaatggcaatattccctaaattgatctacagaatcaatgtgatcccagcatacccaaaagaaatttgaataggaaaaacaaagttgggggactcacacttcctgatttgaaaacataattcaaagctatggaaatcaagacagtgtggtagtggcataaggataaacatacagatcaatggaatataagtgtgggttcagaaataaacctttacactgacagtcaattgattttatgacaaaaatgccaagacaattcagtggaggaaagaatggtctttttaagccaagtgctgtagctgacacctataatcccagcatttggggaggctgagacaggaggattgcttgaggccaggagtttgagactagccagggcaacaaagcaagacccccatctctacaagaaacaaacaatggtcttttcaacaaaccatgctgggacaactgaatattcacatgcagtagaatgaagctggaccactatatctcacaccatacacaaaaattaattctaattaaatttaaacacggattatagacctaaatgtaacagctaaaacaataaaattcctagaagaaaacaaagctaatcttcatttcatttggtggcctgacatcaaaaccacatgcaacaaaggaaaaaacaagtaaatttggcttcatcagaattataacattttgtacattaaaggacaccatcaagaaattgaaaacacaacccatagatgggagaaaatatttgcaaatcatgtatctcacaagggatttgtatctagtatatttaaagaactcttacaactcaacaataaaaagagaatccaattttaaaatgggcaaaggctgagcatggtggctcacaccagaaggagaggatcccttgaggcaaggattctgagacctgccagagcaatatagcaagaccctgtctctacaaaataaattaataataataaaaaaaaacaattagccaggcatggtggcacacacctgtagtcctagctactcaggagcttgaggcagaaggaacccttgagtccaggagtttgaagttccagaaactatgattgggccgggtgcggtggctcacgcctgtaatcctagcactttgggagtccaaggcgggtggatcatgaggtcaggagttcaagaccaacctggccaagatggtgaaaccccatctctactaaaaatacaaaaattagctgggcgtggtggtgggtgcctctaatcccagctacttgggaggctgaggcagagaatcacttgaacccaggaggcagagattgcagtgagccaagatagtgccactgaactccagcctgggtgacagagcaagactccatctccaaaaaaaaaaaaaaagaaaagaaaactgcgattggccactgcactctagccagagtgacagagcaagacctagcctaaaaaacaatagtgtataaaaataaaattaaaatgtgcagagaatttaaatagacatttctccaaagaagatatatgaatggccaataagcacatgaaaagatctcatcaggttgagcacaggggatcaggcctgtaatcccaacactttgggaggccaaggtgcggggactgcttgagctcaggagtttgagaccagcctgggcaacatggtaaaaccccatctctacaaaaaatacaaaaaggccaggtacagtggctcatgcctttaatcccagcactttgggaggctgaggcgggtggatcacctgatgtcaagagtttgagaccagcctggccaacatggtgaaaccccgtctctactaaaaagacaaaaattagccaggtgtgatggtaggcgcctgtaataccagctactggggaagctgaggcaggagaatcacttgaacctaggaggcggaggttacagtgagccaagatcacaccactgcactccaacctgggtgaaaggcaaaaatccgtctcaaaaaaaaaaaaagtttcaaagataaaacaaaaatcttgttaaagataaatacacgagatgctaaagaaataatctacttcttcaagtcatgctatcaatttgcaccaaaattttcatttcctatgtgtaggtgttgagggtcttgtacccatgataaatgacatacacctgttctgggctgacttttgttccccaaaagagatatatagtactccaaggggctgggcacagtggcacatgcctgtaatcccagcactttggaaggtcaaggccacagcatcgcttgagctcaggaattcaatatcagcctgggcaacatggcaagaccccggctctactaaaaatataaaaaaatagccaggtgtggcagtgcacacctgtagtcccagctacccgggaagctgagatgggaggattgcttgagcctggggtttagggggctggaggttgcagtgatccaagtgccactgcactctagcctggatgacagagggagaccctgtctcaaaaaaaaaaaaaaaaaaaaagatatgtagtactcctaacattcagcacctcagaacctgatcttagagacaggatcttcaggccaggtggcttcccttcctctccgcgtcagtctgtcccacctcagctcagcccaccggagacagagggtgcaggaacctggaggcggaggttgcaggaagccgagatcctgcaactgcactccagcctgggcgacacagcaagactccgtctcaaaaaaaaaaaaaaaaccttacaacaaaatgatgcagcccgggcgcagtggctcacgcctgtaatcccagcactttgggaggccgagtggggcggatcatttgaggtcaggagttcgagaccagcctggccaacatggtgaaatcctatctcaactaaaaaaaaaccaaaaactacagaaattagccaggcgtgatggcgcatgcctgcagtctcagctgcttgggaggctgaggcaggagaattgcttgaacccgggagtcggaggttgcagtgagccaagattgcgccgattgcactccagcctgagtgacaagagcaaaactccatctcaaaaaaaaaagaaaatgcaaagtcacctaagagacagtttaaatacataaaaagctcgatgccaaataaaactggatgggtcacttgataagtgggattgataaaaagcaagacagctgatattatataattcttatttgcttcgatatttactggggaaggtagaggggaaaagctatctaaattactcttaataagcatacaaatctctaatagtgaatcaaatgcatcattaaatatactaaattcctcaaactgatatgtcagatgtcaggtagtcatgaagacccaaaatagtctccatgggttttttgttgttgtttttttgagacagagtctcactctgttgcccaggctggagtgcagtggcaccatctcgactcactgcaacctctgtctcccgggttcaagccattctcccacctcagcctcccaagtagctgggattacaggcatgtgccaccacatttggctgatttttgtatttttagtagagacagggtttcactatgttacccaggctgttctcaaactcctgacctcaagtgattcacccaactcggcctcccaaagtgctgggatttcaggtgtgagccaccacgaccagccccttctctgtgttttaaaggcatttaagtataaattattaaactgcaggacagaacatattagctgacggtcatatgagtgaccttctctaaatgccaggaggatagaatccacttttcctttatcaatattttccttgctcaacttctgacatattaggtactcaataagtatgtgctgaaccaaaacgaacaaaaaaatgctgtcatcaaagtaacttccatctactcaagtaggctgcaacttcaaactgcccaaactagcaaatctctaataaagatgggctcagaagacatatcagcatgaataaccttctgaggaaaagacaacatggattctaaaagtggacatcacaccacaccagttcacccaaattctctgagaaaataaatatgtgtggctgggtgacggtggctcatgcctgtaatcccagcactttgggaggctgaggcgggtggatcatgaggtcaggagatcgagaccatcctagccaacatggtgaaaccccaactctactaaaaatacaaaaattagctgggtgtggtggtgagcacctgtagtcatagctactcgggaggctgaggcaggagaaacgcttgaacccgggaggcggaggttgtagtgagccgagatcgcaccactgcactccagcctgggcaacagagtgagactctgtctcaaaaaaaaaaaaaaaaaaaaaaaaaaaaaagacctgagtggccacaggatgagaacatttactgtagactggacataactgagacacagaaaattataggtagatgctgaggtacttccccaaatgaagaagtaaaaacagaagattgaaaatttttttagaaatgctatatttaacattttaatatattgtacaaaaaatatacagagaattccccattttgcagatgggatgatgagattcctaataatgaaataccacacgagttggaaaaataagggaacggagtgatggaaagggtttctaaatatattaaatgagaaacatttgcaaaaactaagatttatattcagcttagagaatgctttggcaagtataaaagctgtctaaatatgtgaagggttatctagcagaagacaaaccagacttgctctaagcagttcccgtgtagacaaaattgggcccaaagtggcaattccagaagggcacgcttcaactcaagctttctaaccatcagacctaactaaaaaggtggttcttaccttggattacctctaagagcccactgagatatgagtgttaaaaaattacatgcgaggaaatggcaggtatgttacagcatggacaaatgaaaagtaaggcatttacaggaaaaaaaatctaagctatacttaaaagactcatgccttcaagtcaaaaaaggaatttttgaataattatagaatattccctaaagacaatgtgatgttctatgcaaaaaaaaaaaaaaaaaaagggagggagggaggaccaaatcctattaggaaaaaactgtaaatcaagggtacccaatcgtttggcttccctgagccacactggaagaagagctgtcttgggccacacataaaatacactaaagtaacaatagctgatgagctaaaaaagaaaatcttaaaaaaaatctcataatgttttaagaaagtttacagatttgtgttgggccacattcaaagctgtcctgggccgcatgcagcctgtgggccatgggtcggacaagcttgctgtaaatagaacatattttcttatccttctaccaaatcacagtgtagttataactaaaatgcagttctgagtagttatcataaatccagaaagggaaagcaatgctgacaaagatcctggaaggaggtttcactggagattaaattaaaaagtcaagcatcttcagttgagaaacatgaaagcaaaggggcaatgtgatcaaaatcagaaaacgtatcaatatggtaaatactaatttattcaccttttatgcttgaaaagtatttctttatataacagataaaagaaacttgtggattgtgttaccacaatctacaagttaaaaatagattcaagtgctcggataaatgtaggtatattaggtccattcaggtcctacaggatagaagtgctatcagacgtgaggccctaaatttctgaggttaacatcttaacagataacaatgtttcacctgaaaacatcacttggtgccaatttagacagaacaattggttggacagaccccggacagacagactcaaggaggctggttggtatagacttccttccattcttttacctcagtatgtatgtgtgtgtaatatatacatacatattatactagaacatatatacattccttatctttatacacttagaatgctccttatatagctctgcaccctgaatttttcatttatcatttactcaacatcctaagacattaaaaattctttttttttttttagacagagacttgctctgtcaacaggctggagtgcagtggcaccatctcagctcactgcaacctccaactccctggtccaagcaattctcctgcctcagcctcctgagtagctgggatttcaggcacgtgccaccacgcccagctaatttttgtatttttagtagagatggggtttcaccatgttggccaggatggtctcgatctcctgacctcataatccgcccacctcggcctcctgaagtgctggaattacgggcatgagccaccgcacccggccagaaaaattctttcaaatactattccatggttgtaaatgtccatccttaaatataccatgatttattttcctataaatcttgctgctcatttaggtttattctcaattctcactaatatgaataatgttacaatgaacatctttgttcacaaatctttctatgtatcttaatttttcccctttaggataaattcctagatgtgcaattactgaattaaagaacgtttttaattttgccaatatatgttgccaaaatatctttcaaaaaaactaggcccaatgcacactccactagcagtttcagagattgtcccctcaccaccttcgacagcacagtcaactgtaaatctgataggttaaaaaaagagtatgtcatttaatctgcattcctttgattacttatcaggataaaaatgtttctcatatgcttcttggtcatttgtatttcttccttatgaactctgatcatgttctttgccagcaaaacttttctttctcttggccgacaaactttctgtggaaaaccagctgagatggaatcatttaaatatcagcaactgcagctccccctgctgacagataaattaccaccaccatcaagtgcccagtaaaaaaaagtgagctagaaccatacgcttgcctgtcttctgggctgctgctacaaatacaaattatacacggtaataaaaaagaaaatactgtgtatctaaactcatacttaacagagctgtgatggagaaggcaagggggacaagcgttttatttgttttttgttgttgttgttgttgttgttgttttttgagacggagtctcgctctgtggcccaggctggagagtagtggcgtgatctcagctcactgcaagctccgcctgctgggttcacaccattctcctgccacagcctcccgagtagctgggactacaggcacccaacaccacgcccggctaattttttttttttttttttttttagtagagacggggtttcaccatgttagccaggatggtcttgatctcctgacctcatgatgggcccgcctcggcctcccaaagtgctgggattacaggcgtgagccaccgtgcccggcccaaacgttttctaatgtgcaggaactaggcggggtgcagtggctcacacctgtaatcccagtactttgtggaggccgaggtgggtggatcacctgaggtcaggagttcaagaccagcctggccaacatggtgaaaccctgtctctactaaaaatataacaatcagccgggtgtggtggcacgtgcctgtagtccgagatactcaggaggctgaggaacgaggattgcttgaacccaggaggtggaggttgcagtgagccgagactgcgccactgcactccagcctgggcaacagagtgagactccatttaaaaaaaaaaaaactaatatgcaagaactaatgtcacaaacaattctaaaaatcaattccctgccaaatatactacctggcacatataaacatcacagacctaaatattcatttccctatactttaactatgtgaaaacactctaaattaccaaatgacactgggtggtcagcaaactagttctctttttccaaaagcaaaaacaacaaaaacacttttgccctttagcattcaaagaaagagtattaaaaatcttaattcttggcaatccttattccaaagttgcttgcacttatcagactgggaccaatagatccaaagagtaaggccaagactggcaaatgcatgtgactctcagcttttccactgataccctcctaaagatgcatgtcccaagtccagcaatacagtctttaacactcatttactaagtgccatcaagagcaagcagtgatggccgggtatggtggctcacgcctgtaatgccagcactttgggaggctgaggggggtggatcacctgaggtcaggagttcgcaaccagcctgaccaacatggtgacaccctgtctctactaaaaatacaaaaattagctgggcgtggtggcaggcacctgtaatcccagctatttgggaggctgaggcaggagaatcacttcaacctgggaggcagaggttgcagtgagccgagatcgcgccgttgcgctccagcctgggcaacaaagagcgaaattccgtctcaaaaaaaaaagaaacaaaaacagcaagcagtgaggataaaagacaagagcaagtcctcactctcaaagaacctagacactagctgggttcaaagtggagcaaactagcaatcagtacaatagaagtgctaggtctgcatatgcacactcacatgcacacacactaacagtttcagagattgtccccttaccacctttgacagcacagtcaactgcaaatctgataggtaaaaaatagtatgtcatttaatctgcattcctttgattatttatcagaataaaaatgtttctcatatgcttcttggtcatttgtatttctttatgaactctgatcataaagtgataatacctgggtccagaggaagcactcagtgtcagctactgttattactattatcactactgttattttgttttaaggctaatcaagtgaagcagtgggagtggagaaggaacaaagaaatctgtaactggctgtgatcaattaatagtaaacaccaatatacttggaccagccactactgttattaaagactagggggagtaagtttccagaacagggtagagtccatcttaagcagaggtaactgcttgtgtgaagacccagaggcaaagaacaacagggttcacagaaggaactgggcacaagctatctgtactactgcgtacaggatgctcaggaagaagtggagagatgatctggcaaaacatttcaactctaccttcaaagctagttgagccatggtggaagagggagggatatgatcatacgcttgaacatgcattttacaaggatcatgttggcagcgacttggaagagagaaagcagtcaaggagaatgattacaagacaacagaaggtcacgcagccaaaagggcgatgaaggtctggactcaaaaaggagaagtaggatgactaggaaaatattatgagctaggatctcaagaatgtggtgactagaatggcacaagaaggaacccagaggcctctcaaatccctgatttgagtgactggctgggtgacactaccgctcactaagatacgaagataggaagaggttggactggggaagtggataagatcattttaaaatgcccataagatggccagatgcagtggctcacgcctgtaatcccagcactttgggaggctgaggcaggtggatcacctgaggtcaggagttcaagcccagcctggccaacatggtgaaaccccatctctactaaaaatacaaaaactggccggacgtggtggcgcacacctgtaatcccagctacccggaggctgaggcaagagagtcgctggaacctgggaggcagaggctgccgtgagccgagaccgtgccactgcactccagcctgggggatagagcgagactccgtctcaatagtaataataataataaaaaaataaaataaaatgcccataggacatccaagtagagatgtccaggaagcaactgtgtatatgggattggagatcagaaaactagtcagagctggaaaaacacacatttgcaaatcatcggcatatagacggcaagtgaggcacaagtttatctaaggcattcctcataaactgcacagggtgagaggaagaagggtcaagggaaggcaaatactaatgtttttaggagcaaaagaggaaaaaagtctgcaaagaaaaccaagagtatgggccagacttggtgactcacacactttgggaggccgaggcaggtggatcacctgagatcaggagttcgagaccagcctggccaacatggtgaaacccatctctactaaaactacaaaaattagccagatgtggtggcgggcacctgtaatcccagctactggggaaactgaggcaggagaattgcttgaacccaggagacggaggttgcagtgagccgagatcacgccactgcactccagcctgggcaaaagagcaagactccgtctcaaaaaaaaaaaaaaaaaagtttcaaagataaaacaaaaatcttgttaaagataaatacatgagaagctaaataaataatctacttctttaagtcatgctatcaatttgcaccaaaattttcatttcctatgtgtaggtgtcgagggtctagtacccatgataaatgatatacacctgttctgggctgaattgtgttccccaaaagagatatgtagtactccaggggcctgggcacagtggcgcattcctgtaatcctagcactttgggaggccaaggccacaggatcgcttgagctcaggagttcaatatcagcctgggcaacatggcaagaccccatctctactaaaaatatttaaaaatagccagatgtggtagtgtgcacctgtagtcccagctactcaggaagctgaggtgggaggattacttgagtccaggggttagggggctggaggttgcagtgatccaagtgccactgcactccagcctgaatgacaaagggagaccctgtctcaaaaaaaaaaaaaaaaaaaaagagatatgtagtactcctaacattcagtacctcagaatgtgatcttagagacgggatcttcagaccaggtgcagtggctcacgcctgcaatctcagcactttaagaggccgaggtgggtggaccacttgaggtcaggagttcgagaccagcctggccaatgtggtgaaaccccatctctaccaaaaatgtaaaaattagctaggcacggtggcgagcacctgtaactccagctacttggaaggctaaggcagaagaatcacttgaacctaggaggaggaggttgcagtaagctgagatcaccccactgtactccagcctgggcaacaaagagagactctaaaaaaaaaaaaagagataggatcttcaaagaggtcataaagttaaaatgaggtcatcagagaggactctaatcccaatatgacttgtccttataaaaaaggggaaattgtggacacaaagaaatacacacagggaggctgggcgccgtggctcacgcctgtaatcccagcactttgggaggctgaggtgggcagatcacttaaggtcaggagtttgagaccagcctgggcaacaaggtgcagccctgtctctacaaaaaatacaaaatttaggctgggtgctgtggctcatgcctgtaatcccagcactttgggaggccaaggcaggcagatcacctgaggtcaggagttcaagaccggcctgggcaacatggtgaaaccctgtttctacaaaaaatacaaaaaattacctgggcatggtgacacgtgactgtaatcccagctacttaggaggctaaggaaggagaatcacctgaacctgagaggcagaggttgcagtgaaccgatattatgccactgcactccagcctgggcaacagagcaagactctgtctaaaaaaacaaaagaaatacacacagggagaactctacataaggactggagttatgctgccaccagaagctagaagagaggcttgaaacagatcctgtcccagttgcttcagagaaagcatgcctctgcccttagatttctagcctccagaacagggagacaataaatttctgttatttaagccactcagcatatgtcactctgtggcagcagccttagcaaacagatgtcataagaaaattcgcagctcaggtttactaagtacctaccaggtgctgttctaaacactctgcgtgaataaactcatttaatccttataaagtccactctaggatctaggtactatcattataccctttttacagtgtggacaccaaggttctaagaggttaatgagcttacccagtatcacatagccagagccctctctctcaccactagtgtatgaggagctattattaacagtaattacaataagagctggcgtggtggctcacgcctgtaatcccagcactttgggaggccaaggcgggtggatcacttgaggccaggagtttgagaccagcctggccaacatagtgaaaccccgtctctactaaaaatagaaaaataagccgggcatgctggcatgcgcctgtaatcccagctacttgagaggctgaggcaggagaattgcttgaactcaggagacacaggttgcagtgagccgagatcgtgccactgaactccagcctgggcgacacagcaagactccatctcaaaaaaaaaaaaaattagtaattacaataagaacagtagtagtccactgaaccaaacactgccctatgtcctttacagatataatacaaaagtcctctgaagtaagtgttattatttccagtatgaaggaggaacctgaatctcagagagattaagaaaatcgcccaaagtcacacggttaagagtgctgagattaggccgggcacggtggctcatgcctgtaatcccagcactttgggaggccgaggcgggtggatcacctgaggtcaggagtttaagaccagcctggccaagctggtgaaaccccatctctactaaaaataaaaaaaaaattagctggccatggtgacaggtgcctgtaatcccagctacttgggaggctgaggcaggagaatcacttgaacccaggaagtggaggttgcagtgagccaagatcacctggacaacaaagcgagactcttgtctcataaaaaaaaaaaaaggaagaagaatgctgagattatatctaattgctaacttaaggggatatacaatgaaaacctgtttttactaaaactttaagaacaagttaattttttttttttctttaatgagacaagagacaaggtctggctctatcacccaggctggactgcaggggcgcaatcacagttcactgcaacctccacctcccaggctcgagccatcctcccacctaggcctctcaagtagctgcaactacaggtgcacaccaccatgcctggctaattttcttttgtatttttagtagagatggggttttgccatgttgcccaggctgttctcaaactcgtgtgctccagcgatctgcctgttcagcctcctaaagtgctaggattacaggcgtgagccatcgcgtctggccaagttaaattttttaatgcctgactttgcagttcaatactagaaatatacatctataaattcaaaattcttgaagatcccaagagaacacatgtcctagattatgggcccttttgcgtgtgtatcccctcaaccactgttcaagaactattctctcggctgggcacggtggcccacgcctgtaatcccagcactttgggaggccgagttgggcggatcatgaggtcaggagatcgagaccatcctggctaacacggtgaaactccgtctctactaaaaatacaaaaaattagccgggcgtggtggcgggcgcctgtggtcccagctactcgggaggctgaggcaggagaatgacatgaacccaggaggcacagtttgcagtgagccgagattgcgccactgcactctagcctaggtgacagagtgaggctccgtctcaaaaaaacaaaaacaaaaacaaaaaaactattctctcagttagaacccttgccatttctctgacttccagacacagaaagagaagaaaaggaaggattgagatgctgttctttaaaatttttttttttttttgagacggagtctccctctgtcgcccagactggagtgcagtggcacgatctcggctcactgtaaactccgcctcccgggttcacgccattctcctgcctcagcctcccaagtagctgcaactacaggcgcctgccaccacgcccagctatttttttgtatttttagtagagacggggtttcaccgtgttagccaggatggtctcgatctcctgacctcatgatccgcccgcctcggcctcccaaagtgctgggattacaggcgtgagccactgcgcccagctaaaattttcaattttctatttaatttttaaaatctgatacaaacatcagaaagtgtaaaaagatataatgcaatgagaagtctccttcctactctgtcctctacctgaacaattcctagacctaacaggtaaccagtgccaccattttcttatttattcttctaaaggtttgtgttgttgctgttgtttgagacagagtctcgcttggtcagccaggctggaggacagcggcgtgatctcagctcactgcaagctccgtctcccgggctcaagcaattctcctgcctcagcctcccaagtagctgggattacaggtgtgtgccaccatgccccagctagtttttatattttcagtagagacggggtttcaccatattggccaggctggtctcagactcctgacctcaggtaatccacccaccttggactcccaaagtgctgggattacacgtgtgagccaccatgcccagccctaaagatcttttttttttttttttgcatacatacaccaatgcaaattatctttttctcctgtttttttttttccaaaaaacacaaagggtatcaaatcatacatactgttctgcatcttgctttcatcacttaactgtctgccttgcagatctttctatatcatattaaattatgttttaattctctcgttttgcttgtcaagaacagtttttacttcatttcaccatagttcagtctagcacacaaggcatccagcagccctaagaactacctgaaacaactgatgatggctccatgctacacactaaagaccctgtatcttttctctcctcctcatcttcatttcactcttttctccgactcactcaattctccttcctttccctattcctctcccatctcacccactccttagccctaaccctgacaactagaccctagtaacatcactgacattgcttagtcgtggctagaaatattcaggctttaaaaaggtacagacccctaacacagagaaaaagggataaataataatttccatgagaacttctaattaacgagagtgccttaaattgaggagttttggcttggagttattcttccttgttacttgcctcctctggcattttcatttgtgaagactgagtgagtgtgacgctattttctatacgcatggaaacaagcacatactcagtctaacatttacgcaatgcctgacagaacgacagagttcattctacaataagataattggaaacaaaatataagatctatataaaataaacatttgggctccaaaatatgcactttaattaacctatcatttctttttacttaaattaagtagctccaatctgaaactacatcttagaaatgttttaaggatattcaccaatgaaaaagagaataaagttccctctccccacttttattttccagcccacaaactcaatgctatcctccccgcaaaaaggacctttttttctgaccagacgaacactgtaatttttaaggtttctaagtaataaaaataggaagaaaacattaccccccaaaattggtttacacttagaagatgtttcccactgagcaaaggattggtaaggaacataatattaaggcaaccacctaactgcattcttaagtagtaacaggtggtaactcacgatatggagctgatttcctttctctattcctgccatgccagagacctctagtagaacttctgaggttactgtattacaacccaggttcagagagatttagaggtaaaaccttaaacactggaaatatctttaaaagtagggctttgtgtaccaaatacattcgttaaaacctaggaaactataaaatgaaatccaatgtattgatctcaatccccttgcctgcttcctaaagaggacagaggccaccaacactggtgctcaacacttgctaagtcgaaacactcttacacaggtcctctgattcttaacgggttcagaacttctggttgcattccccatgcaacccctccaactctacagggagaatgctggaaaaactgtgtcactttggcttcctgtatattaatataagcactcttatccagcaatagcagctgaaacataaatgaagatgagaactcagcctacatgacctaagatttcccacaagtccagatatttaggttacacacactgcactattgtctgatttctcctctgcatcaatctggaagtccacagagcagattagcacccaacaatcttaactaagctagtatcctactctgaagaaaggcgaagctggtggagggtttccaagactccttatccttctctgtccttcctcccatcccctccttacgtcttttctgtttgtttttatttaattttttttttaatgtatttttagtcacaagaaaatcaaagaagccacctacttaagtcttaagctctgccctttgcttagtcctaatggagagttctttggccatctatgtacaagagattagaggagccaaagagactggagaaccacatcaatgggagctttttcatctaaaggtcatctgtccacactgtccaaatgaggtttaccctgtgaaataaaacttggtgtaagtgctacctgctgagaaaaatagtatgaaatgtcacacaaaggactggggtgcagcaggaggactctgaaagagtcatacgtgtaaaccagcaggtcttagaatgccctaatatactatatgaagtttcagagtaaacaaatggttaatgacacatcttttgtaacacatgaatcagctactgatttgcaagagtgggacacaccctagtacctatgactctaaagtacctgtttgaaaagtggacctagatgtttgaattgccaacccatcctaagaccggaacataattttacaactatgtaagttgccataatttaaagttaaaaagatcactgcctttcattataatggaagttaatttgagaacttcattaaaacattcacaccgataatcaaagaacagtagagatacaaagtaaaatatagccaatcaatcctaggaagcaaacacaagaggcaagagaaatggcaggtaaaggaagtgaagaatagcaaattcaaaaactacaatattcccaattctaaagaaaaatgaataaaatgaggctggtaatgaaaaaataacacatcttaccttaagaggcatccaagtagcattcatagtgtcaggatataaagacaatactcagaaatgagcaagaagtcttagtaattccctcggttaccaagtataagcaggtaggaaaatcttttgtttcgagaaggtatctgaaagagaggattttcatttagactaaaaaataatcaagacaatgcaaatagtttaagctacctgggcagggattttgaagtactatttgcctcatcgcactaaaaaagtatagaaaatacagtcccctttagaaaagggcaaatgtgtgtctccatatatatgtgtgtagaaacatactttacataaaaagagaaataaatatgtaacacgtattttagataatgtaaaattgcttatcaaacaattagccaaaatcccagagagaataaagtaattttccagggtacttcataaacactaaacgtgatttgttaactaaccgtctaaagaaagacccttgccacatttaattatatttagtaaagtaaaacttctctaatcatcccgactgtcccaagattatgcttaagtttcagagtcaattccacatgaaaagtaaaacctattcttgactgaagtactagaaacaaataaaagacccttcttccccagagatcgttaaaagcagaccgagcaacttaattttgagggtgggaggaaggtaaatttgcctggaggcaggaggatggactaaatgacctctggtaggatcctcgttcaagtcctgggcctgtatacaattccagcttaaccagttactgcttcgcttaaaatggaggcttgcctgcgtagggacaaaaataacagcacccacttcttaaaaataaatgtcgaaaagtacccctttttaaataaaaataaaaaataaacacctctggagtggatgtgttcttgctatgcgtttgtcactgaggcttcgaagacttggcatcactttccttaccgctcaccggattttgggggaggagcggggggcgacagtttgactcttgacccaagtctcaggcggacttcagagccccacaggggcccccaactccagagccagagggagcggagaggcgagagcccgagatcgcacctccccccaccgcggaccccagtcccaaacccacccctcacctccccgcagtggggcgcctccttctgccccattcccattgttagggagggcagagcgcggggtgggctcagggcaggggcgcccgcggccgttgcccggctcgcttcaggaggggcgccccgcgggatgcggcttcccttcctctccgcgtcggtccgtcccacctcggctcggcctggcgccccgaggtccgctccgcgcccccggccgcggccccggcccgccccccgggcagccaggccctcaggccagtcggccggcagccggcgtcccaggcctacgagtgggcgctgggcgggggtccccgtgccccacacacgcgtcccctctcccccagccccgccgcttccagggccctcggcggcgcccgctccccgggccccgcggccccccgcctcccagccgggccgctccctcgagctcgtcgggtcagggacacctcctctacctcaccatcaccctggcccactcgtgcccccacccccaggggcaccagtgccaaaggcagctcccccagccccggacctacctgcacggttcaaccaagcctagaagtgggggcggggaatcttccgccctcctctggcgcccattggcccttcaggggcacatcgtgagcgccattggctgagcaatggtgtccgtcagagcgatggggcgggacagaagggggagagggatgctggtgccttggcgtctctgtctctgtgtatctcgttgtctctgtctctgtctcggcccttggaaacgagaggcttttggctgagaggactagaagggggcctgaggtgggaggaataggaataggaatcctgacagagcgtcacgccagttggccactctgaacgccctacctaagtcccctttaggttctcttctccatcacccccaacccctgcccctcacccctcgaggttctttcatccaggaagcgacgtgatgaaaactccaggccggaaggccatagggagagatgttatatatgtatataaaatatacacataaaaatgtttatatataaactcaaccagatatcagttcactagggcctggaaaggaaagggcacacatctcacagacagggaaggacttgagatagagccggtagaagaaggaatcaaaaatcactctaagagctggcaacagtggttacctcctgggagaggaactgagtgcctagggaaccagtgggcggaagacttacatatctcggcatatcatttgtatccattgatttttgcaccattcatcaagattccaatttaaagaaaaggatttaaatgtttaaataaggtcgcaaaaccaggggacagacaagataattgggcaggaaaattggcgcaacatgcagatttggggaggaatcttagcttttaatatgttcagctcccggtaacagggttttgtaaaacccagtgaaggtgtcccagaggcaactgaagttatggaacttgagagagggtagacaatcaggactagagaagatgcagggtcctctgcctaaagatagtgatctatgacatgctaaaggataaactcccaaagaagggtaataagacacccacagtaaaaggtaggaggacgaaaaagaaggtcagtgaggtaaaagaaacaatattaaagaggcatgaaaattaagggaggaagggtctgtggaaaatagaataataaaactatgagagaggccgggcacggtggctcacacctgtaatcccagcactttgggaggccaaggcgggtggatcacctgaggtcaggagttcgagaccagcctgcgcagcatggtgaaacccgatctctaatagaaatgcaaaaaaaaaattagccaagcgtggtggcgcgcctctgtaatcccagctactggaaaggctgaggtgggagaattgcttgaaccgggaggcggaggctgcagtgagccaagatcgcgccactgcactccagcctgggcgacacagtgagaccctgtttcaaaaaaaaaaaaaaaaaaaaaaaaacaacaaacaaactgtgagagcctcataggtcttacctctttacctctttaggctctggtaaccatgggacaataagaatgaaagccaaggccgggcacggtggctcacgcctgtaatcccagcattttgggaggccaaggtgggcggatcacaaggtcaggagatcaagaccatcctggccaacatggtgaaaccacgggcatggtggcgcatgcctgtaatcccagctactcgggaggctgaggcaggagaattgcttgaaccagggagtcagaggttccagtgagccgatatcacgccactgcactccagcctggatgacagagtgagactccgactcaaaaaaaaaaaaaaaaaaaaaaaaaacaacacctttatcgattaagaatcttttttctgagtttattaattctatttaaatcaaccccagaaaacaccttcaacacagcctctcatttcatatctgtaaaatggggcaaaaaaaaaaatagttcctaccctttagagttgttgtgaagattaaattagtgaatacatatgatggatttttttttcttttttcttttttatgagacacagtctcgctctgtctcccaggctggagtgcagtggcactatctcagctcactgcaagctccgccttccgggttcacgccattctcctgcctcagcctcctgagtagctgggactacaggcgtccgccagcatgcccgactaattttttgttatttttagtagatacggggtttcaccgtgttagccaggatggtctcaatctcctgacctcgtgatccgcccgacttggcctcccaagtgctgggattacaggcatgagccatggcgcccggcctgtgtgatggattttttaagagcctgactggcggggtgaggtggctcatgactgtaatcgcagcactttgagaggctgaggcaggtgaatcacttgaagccaggagttcgagaccagcctgggcaacatggcgagacctcgtctctacaaaaacacacacacaaaaattagctgggtatgatggtgcatgcctgtagtcccagctactcaggagactgaggtgagggtcgcttgagcctgggaggcagaggttgcagtcagccgagatctcaccactgcatttcagcctgggtgacagtgtaagaacctgtcaaaacaacaacaacaaaaaaaacaaaacaacaacaacaaaaaaacgcacgaaaaaaaccacataagctccttgagggcagaaactgtcccctagtcttctatattttatttcacacaatgtacagaagactaaatgaataattgttagctggtttttttttttaaaggggataagatcagttacaatgtctttttcctcagtcaatcacataagtatctaaaatgacattccaaagtaaggacaggagtttaaatcctgaactatggtatctaaagtaaacttgaactttccttatttttaaaaaattttggccgggcgcggtggctcacgcctgtaatcccagcactttgggaagctgaggcgggcagatcacaaggtcaagagatctagaccatccttgccaacatggtgaaaccccatctccactaaaaatacaaaaattagctgggcgtggtggcacggacctgtagtcctagctacttgggaggctgaggcaggagaaccgcttgaacccgggaggaggagactgcagtgagccgagatcacgccactgcactccagactggcgacagactgtctcaaaaaaaaaaaaaaaagaaaaagaaaaaagaaaagaaaaaaattccatacatagaattctgtgtggcattttagagaaaatcatggtgactagagacaccaggtgaaatttttttttttttttttttggtgacacaaccccaggagatcctgtgaacatgtgtcccttgaccaggtgaatttcaggagcttgcactagtcccaggttagctggcaccaggttggccctagtttgagtgccttccacataccaggtactgtgctggagaagtaacatcaaaaaggaaaatcaaatttcatcttcaataagcaatcacaatacactgtgatgagagttagggtgaaggaggttcaggttaccatgggcttatattaggagggcaaattctgtcttcaagtctttttgcttcaacagtagcgtttagatcttgtgggctgggcatggtggctctagcctgaaatcccagcactttgggagggtgaagtgggcagactgcttgagcccaggagttgcagattagcctggcaacatggcgaaaccccgtctctacaaaaaatacaaaagtcagccaggcatagtggtgcctgcctgtagtttcagctacttgggaggctgaggtaggaggatcgcttgaccccaggagttcaaggctgcagtgagctaccatcgagccacttcacttcagcctgggccgcagaataagaccctgtctgaaaaaaaaaatcttgtgatataataacagcttgtgcactcttcgatagctcagctggtagagcagagggctgtagactgcatagataataataacagtttgcgtttttgagtcaaagatgataccccagaatcattatcgaaaataatggttgatccattcacctgtgcctatgactgtgagccacattgtgaccaatctgtgagcaacatgggtgggaatgcagtttggggccatggaactcacttaacaggaagttccaatagcagtggatttaccatgttgcggctgtaggatcttggacaaatatttaatgacctctgtctctcagttctctcaataataaaacatccctccgagagttgctgtaaaggttaacatagggggagtcttgcaaatagtaggtgctaaaatcctgtcttgaaaaaaaaaaaaaaatatatatatatatatatatatatatatatatatgaagagatgagatcttcaattgtacagactgtccctgtacccattcatttgcatttcttttcctttacaataatacatatctatgatttcctttcattcccactgtcatcaatttagttagattactgggcagagatcaccagtggggctagagtaaaatgaaaataaatgtacattgactctaggtattcctaagtaatagcacagtttactgtgttctccctcataaatcctggtagctgaatgttgcctgcttttagcagttacgtttctgctcatctcaccctcaatgttcattaagaaaatagttattgaatggccaggctcactggctcacgcctgtaatctattacaggcgtgagccaccgtacccagccttggttatcatatttctaatttataatagtttttcttgttttcttattgttcattttttatagcatcctgttcttatattatggatatatatcttcaggtctcgctgaagaaataaagaggtgtatgtgtatatatgtgtgtgtgtattatctttatttttattttttgagatggaatcttactctgtcgcccaggctgtagtgcagtggcgcttttgggaggctgaggtggaaggatcacttaaggccaatatttggagaccagccagggcaacataacaagacccccatctctacaaaaaaattaaaaattagctggccatggtggtgagtgcctgtagtctcagctacttgggaggctgaggcaggaggattgcttgagcccaggaggttgaggggggaggtgagccatgattgagccactgcactccagcctaggtgacagagtgagaccccatctctaaaaaaaaagagagagagaaataaaatagttattgagcacctactgtatgtcaggtccaagaccctaaagatgtaaagatgaataaggtggtgaccctgccttccagtttccacaaaggtggggaatatggataaaagcagacaaagccattgccatgggataagggcagagaatagcatgtgcaaattatagaaggtgagggataatataccactttccagaaactgatggttcaatgaggctaaagcatggagttcaagaaaggaaaccagatgagattaactgcaatgtggttctcaaacttaaatgtgcataaaaactggccttgttgactgggcacagtgactcacaccggtaatccaagcactttgggaggtcgaggcgggcggatcgcttgaggtcaggagttcgaaactagcctggccaatgtggtgaaaccccatttctttttttttctttttcttttttttttttttttttttttgagacagagtctcgctgtcgtccaggctggagtgcagtggcgtgatctcggctcaccgcaagctccgcctcctgggttcacgccattctcctacctcagcctcccgagtagctgggactacaggcacccgctaccatgcccggctaatttttttgtatttttagtagagacggggtttcaccatgttagccaggatggtctcgatctcctgacctcgtgatccgtccgccttggcctcccaaagtgctgggattacaggcgtgagccaccgcgcccggcctgaaaccccatttctactaaaaatgcaaaaattagctgggtgtggtggtgcacacctatagtcccagctgctcaggaggttgaggcgggagaatcacttcaacctgggaggtggagatggagtaagccaagatcaagccactgcactccagcctgagtgacacagcgagactctgtctccaaaaaacaaacaaacgaacaaaaaactggccttgtttacatagtctcgcaagctccaagcctagagatcttgatggagcgggtcagagtgctgctgctcggagggctacactctgagaaccaccgatggagaagaagggcggggtcaacttgcagagctgtgctgggaggtgtgtgctgcagccttgagggggtgaagaacctttgagaggttttaagcctgcaagagatgtggtcacatttatattttagaaaaatcaccctgtgtgcaatatgaaaaatgaaacagagagggcaagactggagtcagggagagcagttaggaggctgctgcagaaacccaggcaagaaatcataaagacctgaaataaaacaatgccagtggggaacggggaagagaggccaaatccaaggggtatttaggagccagaattgagagggtgtgatgagtgttgatgggatacaggacaggatcctgagatggcttgcaggtcttcagctttgagtgacccatggaagcgaaggaagatgggaaggagggtgcctatcacacagagagaatgaaggtttgagaggcaagtgtagcttttgacattttgcttttgaaatgtctatgggacatcagaaataatctcaaaagaccacaagtcaggcagggcgcggtggctcacgcttgtaattccagcactttgggaggccgaggtgggcagatcacgaagtcaggagctcaagaccagcctggccaacatggtgaaaccccgtctctactaaaaattcaaaaattagctgggcatggtggcgggcacctgtaatcccagctacttgggaggctgaggcaggagaatcacttgaacctgggaggcggaggttgcaatgagctgggatcgagccatcgcactccagcctgggcaacaagagtaaaactctgcctaaaaaaaaaaaaaaaccatgagtcactggttaacagcctgagcggcagaaatctcacagttctgagtctgaatcctatctagcctggctctgaaactcacaatctggagctggggcttggtgcagtggctcaggcctgtaatcccagcactgtgggaggctgaggcaggtggattgcttgaggccaggagtttgagagcagcctggccaacatggtgaaaccccatctctactaaaaatacagttagccaggcatgatggtgtgcacctgtaatcccagctacttgggaggctgaggcacgacaatcgctggagcccaggaggcagacgttgcagtgagccgagattgtgctactgcactccagcctgggcaacacagcaacactgtctaaaaaaaaaaaaaaaaatgctgggcgcggtggtttacgtctgtaatcccacttttagaggctgaggtgggaggatcacctgaagccaggagctcaagaccagcctggccaacatggtaaaacccgccatcccctccctgccatgccccatctcccccaacactctcccaccctgtctctactaaaaatacaaaaattagccgggtgtggtggcacacacctataatctcagctacatgggaggctgaggcataagaattgcttgagcccggaaggtggaggttgcagtgagccaagatcgcaccactgcactccagcctgggtgacagagcaagactctctcttaaaaaaaaaaaaaaaaagaattttttttttaaatatagagatgggctttctgtgtttcccaggctatactcaagctcctgggctcaagctattctcctgcctctgccttcaaccagcctcaatcctccaattttcttattttttatatttttcaacaccttttaaattctacattctggccagctgcagtggctcatgcctataatccagcactttgagaggttgagatatgagacttgcttgaggccaggagtttgaggcttgcagtaagctagaatggcgccacggcacagcagcttgggagacagagcaagaccttgtctcaaaagaaaaagaatttaaatactacattctaggagatttcttcaaccttcaaattttgtattgaatttttaattttggcttttatttatttattttttttttgagacaggttctcactctgtcacccaggttggaatgcggtggcttgatctcagctcactgcaacctctgcctcctgggttcaagtgattctcctgcctcagcctcctgagtagctgggattgcaggcgtggtccagcatgcccagcttatttttgtattttcagtagagacggggtttcaccatattggccaggttggtctcaaactcctggcctcaagtgatccacatgcctcagcctcccaaggtgctgagattacaggtgtgagccactgcacccagccttggctatcatatttctaatttatgatagtttttcttgctttcttattgttcattttttatagcatcctgttcttatgttatggatatatatcttcaggtctcgctgaagaaataaagaggtgtatgtgtatatgtgtgtgtgtattatttttatttttattttttgagacggagtctcactctgttgcccaggctggagtgcagtggcacaatcccagctggctgcaacctctgcttcccaggttcaactgatcctcccacctcaatctcccaagtagctgggattacaggcacctgtcaccatgcccggctaatttttctttctttgtttcttttttttttttttttttttttttttgagatagagtctctgttgcccaggacggagtgcagtggtgtgatctcggctcactgcaagctccacctcctgggttcaagagattctcctgcctcagcctcccaagtagctgggattacaagcgtgtgccaccacacccagctaatttttgtatttttagtagagatggggtttcaccatgttgtccaggctgatctcaaactcctgacctcaaatgatccaccttcttcagcccgccaaagtgctgggattacatgcatgagccaccacaccagcaaaatttttgtatttttagtagagatagggtttcgccatatgtgtgtgtgttttaagtttttctgttttcatttctcttggcatatatacctcggaatggaattactgggtcatatgggagctctgtgttaaacacttgtgtcatatctaagaaaacttgctaatccaaaggtcataaagatgtatgtctatgttttcctctaaggccaacatggtgaaacactgtctctattaaaaaaataaaaactgggccgggcatggttgctcatgcctgtaatcccagcactttgggaggccaaggtgggtggatcacctgtggtcgggagttcgaggccagcctgatcaacatgcagaaaccccgtctctactaaaaatacaaaaaaattagcagggcatggtggcgcatgcctgtaatctcagctacttgggagctgaggcaggagaatcgcttgaacgcaggaggcagaggttgcggtgagccaagatcgtgccattgcactccagcctgggcaacaagagcaaaactcggtctcaaaaaaaaaaaaaaaaattagttgggcgtggtggcgcgcacctgtagtcccagctactccagaggctgaggcaggagaatggcttgaacccaggaggtggaggttgcagtgagctgagatcatgccactgcactccagcctggcaacagagcaacagagcaagactccatctaaaaacaaaaaaaagagttttctacttttcagtctaacaaatgttttataaacaaaggctttgttatattttgagttaatttttatagataatatgaggtgaggtttcaacttcattctattgtgtgtgggtatccagttgtcccaggaccattgtttgaaaagacttttttttctacactttctctcattgaattgtcttggcatatttgttaaaaatcagttgaccttggctgggcaccatggttcacacctgtaatcccagtattttgggaggccaaggcaagaagaccatttgagcccagaagttcaaaacccgcctgggcaatataggcacactccatttctaaaaataattattaaaaagattagctgggcaggccagacatggtggctcacgcctgtaatcccagcactttgggaggccaatgcaggtggatcacctgaggtcagaagttcaagaccagcctgaccaacatggagaaaccccatttctgctaaaaatacaaaattagtctggagtggtgactcatgcctgtaaatcccagctactagggaggctgaggcagaagaattgcttgaacccagaaggcggaggttgtggtgagccgagattgcgccattgcactccagcctgggcaacaagaatgaaactctgtctcaaaaaaaaaaagattagctgggcgtggtggcacatgcctgtggtcccagtgacttaggaggctgaggcagggggatcgggagacggaggctgcagtgagccttgatcactgcactccagcctgggtgacagagtgagaccctgtctcaaaaaagaaaaaaaatcagttgaccgtaatgtgagcactcatttctggactttcaattctattccattgatctatatgtcagtccttatgccagtgcccaggggctcaactactggtactgtgaattagattttgaatcaagaagcgtgagtcttccaattttgttcttatttttcaagattgttttgtctatttgaagttccttacaatttaatgtgaattttagaatcagcttgtccatttttgcaaaaaaggtagttgggattttgatagagattgtgttgagtctgtagatcaatttgggaggcattgctatgtgaagagtagtaagtgtttcaatccatgaacacacaatgtcttttcatgtatttaagtttaatttctttcaataatgttttgtagtttgcacttccttggttaaattcattcctaagttttttttggtgccattacaaatggaattgttttattaatttcatttttggattgttcatttctagtgtatagaaattcaactgagccaggtgtagtggtgcaccacctgtagtcccagctacttgggaggctgagtcaggaggattgcttgtggccatgtttgaggctatagtgcattataattgtgcctgtaaatgatcactgcattctagcctcggcaacatagtgcagtcttgtctcttaaaaaataaataaataaacaactgatttttgtacgttgatcttgtatcctccaactttgcaaaattaatttattactattaagactttgtggctgggcacggtggctcatgcctgtaatcccagcactttgggaggccaaggcgggcagatcacgaggtcaggagatcgagaccatcctggccaacacggtgaaaccccgtctctactaaaaatacaaaaaattagccaggcgcggtggcaggcacctgtagtcccagctacttgggaggctgaggcaggagaatggtgtgaacccgggtggcagagcttgcagtgagccaagatagcgccactgcagtccagcctgggcaaaagagtgagactccgtctcaaaaaaaaaaaaaaaaaaaagattttgctttattttgtgtttggtgtggatactttaggaaccaaaagataaataaataagaacaaggtctagcactttggtcaaatttattcctaagtgtgtgtttgtaaacgatattgtaaatgaattttcttagtttcattttcagcttgctaattgttactgtatagaaatacaatttatttatttatttactttttttttttttttttgagacagtctcgctctgttacccaggctggagtgcagtggtgtgatctcggctcactgcaacctctgcctcctgggttcaagcaattctcttgcctcagtctcccgaacagctgtgattacaggtgcgtgccgcaacccccagctaatttttgtatttttagtagagatgggttttcaccatgttggtcaggttagtctcaagatgttcttttttttttttttttttatcattttatttatttattttttaatttttatttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcctgcctttctattccacaaagccgccattgtcatcctggcccattctcaatgagctgttgggcacacctcccagacggggtggtggccgggcagaggggctcctcacttcccagtaggggcggccgggcagaggcgcccctcacctcccggacggggcggctggccgggcgggggggctgaccccccccccaccggtcaggttagtctcgaactcctgacctcatgatctgctcacctaggcctcccaaagtgctgggattataggcatgagccactgcgccaggccaattttttttatatcactcttacacctgcaactttgctgaatttgtttacttgttctgacggttttgtggattccttagaatttcctacatacaagatcatgtcatatgcaaatacatatggttttatttcttcctttctaatttgtgtggcttttatttctttttcttgctaatttcctggctagaaatttaagtataatgttgaatagaggtggcaagagtgaatatccttgtcttcttcctgatcttaggagaaaaacttatagtctttcatcattaagtattacctgtggggctggatgcgatggctcaagcctataatcacagcactttgggaggccaaggcgggtggatcatttgaggtcaggtgttcaagaccagcctggccaagatggtgaaacccccatctctactaaaaacatctctactaaaaatataaaaacttggcggggtgcagtggctcacacctgtaatctcaccactttaggaggccgaggcgggcagatcacgaggtcaggagatcaagaccatcccggctaacacagtgaaacccatctctactaaaaatacaaaaaaaaaaaaaagaaaattagctaggtgtcgtggcacacgcctgtagtcccagctacttgggaggctgaggcaggagaatcgcttgaacccgggagacagaggttgcagtgagccgagatcacaccactgcgctccagcctgggcgacagagcaagactccatctcaaaaaaaaaaataaacgtaaattagacaggcatggtggtgcgcacctgtagtcctagctactcaggaggctgaggaaggagaattgcttgaacctgggaggcagaggttgcagtgagtcgagagcatgccactgcactccagccagggtgacagagtaagactctgtctcaaaaaaaaaaaaaaggatttatgggaagtaattaaggtcaaatgaggtcataaagctgggcactgatctaatagaattagtgtctttatgagacgagaacccagagagctccctagctttctctctgccacatgaggccacttcaagaaggcaagccaggtaataaagcccacgctgaggtaggaggtggaactggactccagagatggggcttggacaccagaccaaattgatgactagctgaaacagggacagggtgaaagcagctttccataagacacgctcaaccagtgcaccatgtcagcttaccatttccatggcagaacccagagttaccaccccaccgccttttttttgagacggagtctcactctgtcgcccaggctggagtgcagtggcacagtcttggctcactgcaagctccacctcccgggttcaagcgattctcctgccttagcctcccgagtagctgggattacaggcgcctgccaccgcgccaaactgatttttgtatttttagtagagacagtgtttcaccatcttggccaggctggtcttgaacttttgacctcatgatccacctgccttggcctcccaaagtgctggaattacaggcctgagccactgtgctcagcctaccacccctttcaatggcaacaacttgacaacccagaagttatcagcctttttctagaaacgtctgtatagtctgccccttaatttgcatgtaattaaaggtcaatgtaaatatgactgcagaactgccctgagctgctactctggtcacactacctacagggtagccctgctctgcaaggagcagtccctctgctgttgctataggccactgcttcaataaaagttggcatctaggccaggtgcagtgggtaatgcctgtaatcccagcactctaggaggctgaggcgggtggatcatttgaggccaggagtttgagaccagcctggtcaacatggtgaaaccccatctctactaaaaatacaaaaaaattagttgggtgttttggcgcacacctgcactcccagctactcaggaggttgaggcgggagaatcacttgaacccaggaggcagagtctgcagtgagccactgcactccagcctgggtgacagagtgagaccctgtcccgaaaaaaaaaaaagttggcctctaacaccttcggtttgcccttgaattatttcctgggtgaagccaagaaccctctcagtctaagccccagttttgtggcttacctgccctgcatcaacaccagaaacttaaccctttgggaatctcgatcttggactttctagcctctagaaccatgagaaaatgatctgtattattaggctacccagtctatgatattctgttgtagcctggggtgactaagacattgagcctgtatgacttgaattttgttacctgcttggccccttgatggcatttcagtttgtgactcttggtttacgtgatcacgaagccaaaactgtttaggaaggaagcaaaatcaagacagattaaaaataaaaataaaaaataaaaggctgggcaccgtggctcacgccctcccagcacgttgggaggcaaaggtaggcagataacttgaggtcagcagttcaagaccagcctggccaacatgatgaaaccacatctctactaaaactacaaaaattagccaggcgtggtggtgggcacctgtaatcccaggtatttgagagggaggcaggagaatcacttgaacctgggaggtggaggttgcagtgagccgagatcacaccactgcactccagcctgggtgacagagcaagactctctctcaaaaaataaaataaaataaaataaaataaaataaaataaaataaaataaagagccgagcacgctggctcacacctgtaatcccacacttcgggagaaagaggtggcaggattgcttgagcccaggagtttgataccagcctaggtaacatggcaaaatcccatctcaattttaaaaaaattttaaaaaagaataatagggctgggcacgatggctcatgcctgtaatcccagcactttgggaggccaagatggatggatcacctgaggttgggagtttgcgaccagcctgaccaacatggagaaaccccatctccactaaaaatacaatattagcaggtcgtggtggcacatacctgtaatcccagctactcggaaggctgaggcaggagaatcgcttgaacctgggaggtggaggttgtggtgagccaagatcgtgccattgcactccagcttgggcaacaagagtgaaattccatctaaaaaaaaaaaaagaaagaaagaaataaggtattttacataaagattaaaaagaaattaaaaccattatttgaagataatggcttaaacagaaactctgcaaatccttagaataagaaagttcaggccaggtgtagtggcttgtgcctgtaatcccaatgcattgggaggctaaggtcggaggattgcttgagcccaggagtttgagacaagccgggtcaacataatgagatcgcatctctacaaaaaattgaaaaatgagccaggtgtggcagtgcgtgcctgtagtcctggctactcaggaggctgaggtgggaaggtcacttgagcctgaagagttcaaggctacagtgttatgatcatgccactgcactgcactccagcctgggagacagagcaagaccctgagaccctgtctcaaaaaacaaaataaaaaaccctcactatattgaacacaacatcaatgttcaatagccactctccttctccttttctaataaaattccacttttttgtgttccatcccaggaccacgatttatctaaactggtcattctggatcaataagtttggctaaaaataaataatatcgaaattggtcacaggaaatctattcttttttttttttttttttttttttttcagacaaagtctcactctgtcgcccaggctggagtgcagcagcatgatcttggctcactgcaacctctgcctcccgggttcaagcaattctctgcctcagcctcccaagtagctgggattacaggtgcctgccaccacgcctggctagtttttgtatttttagtagagatggggtttcaccatcttggccaggctggtcttgaactcctgaccttgcgttctacctgccttggcttcccaaagtgctgggtctgtcacccaggctggagtgcaatggtgcaatcatggctcactgcagcctcaacctccctgggctcagatgattctcccaccttagcctctcaagtagctgggattaaaggcatatgccaccatgcccagctaatttttctattttttttgtagagacagggcatccctaccttgcccaggctggtcttcaactcctggtttcaaaggatcctcctgcttcagcctcccaaagcactgggtctattattccctttcatattcaaacttaattctgcattttcaaggccttgaattttcaagggcagctttttctgtccctgaacttaatcttcagctcctctcacctcctgggaggttggggggtggggaagaaaagtcccaaccctctaatcctgctttggtcttttgccgccagcccccatcctgaagctaccagtcaatttgtttgcatacaagaagatatcactttggagattctaagtgtatacgaggaaatgaggtcaaagaccaaatatatatatttcactatatcacacttcaaacttttgtttactgtttcccttctcctactctattataaacctttgagggtggggactgtgagttatttatctttatattcccagtgtcaagagtgtttagctataatgggaatgaatctcaaagtttcttgaataaatgacaagaagaatcatagttgcatgaactaaattcattattctcagtccttgaggtaaatgaatatattgatattatgtctgcttactctttttttgcgagagagagaaagaggagggagggagggaaggaaggaaaaaaggaaggaaggcgaaaagagtgaaagaaaagagagagaaaaagagagagaaagaaggaaggggagggaaggaaggaaaagaaggagggaagaagggaaagggagggagaggaagaaaagaaagaagaaggaaggaaagaaagaaagaagaaaaggagggaggaaggaacgaagaaagggaaagaaggagggagggagggaaatgaaggaaagaaagaaaaaagaaagaaagaaaaaagaaaagaaaaggagggaggaaggaaggagggagggaaggatggaagaaagggaaagaaggagggaggaagggacatgaagagaataaagaaagaaagaagaaaagaaaagaaaaaagaaaagaaaagggagggctctgcgggcggcggcggcgcggggagccggttgcaggccgagatgctgcagatggacctgatcgacgcgacgggggacactcccggggccgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgcagttgtctcaggacacactgaataataattctctgggcaaaaagtacagttggcaggatcgggtgtctcgatcatcctcacccctgaagacaggggagcagacaccaccgcatgaacccatttgcctgagcgatgagctgcccccccagagcagccccgcccccaccacagatcgaggcacctccaccaacagcccacgctgctggagctggtgagcctgcggccgtgcttcagagactacagtgacgagagtgactcggccatcgtctacgacaactgtgcctccgtctcctcgccctatgagtcagccatcggagaggaatatgaggaggcctcccggccccagcctcctgcctgcctctccaaggactccacgcctgacgaacccgacgtccatttctccaagaagttcctgaacatcttcatgagtggccgctcccgctcctccagtgccgagtccttcgggctgttctcctgcatcatcaaccgggaggagcaggagcagacccaccggaccatattcaggtttgtgcctcgacacgaagacgaacctgagctggaagtggatgaccctctgctagtggagctccaggctgaagactactggtacgaggcctacaacatgcgcactggtgcccggggcatctttactgcctattacgccatcgaggtcaccaaggagcccgagcacatggcagccctggctaaaaacagtgactgggtggaccagttccgggtgaagttcctgggctcagtccaggttccctatcacaagggcgatgtcgtcctctctgccgctatgcaaaagattgccaccacccgccggctaaccgtgcactttaacccgccctccagctgtgtcctggagatcagcgtgcggggtgtgaagataggtatcaaggccgatgactcccaggaggccaaggggaataaatgtagccactttttccagttaaaaaacatctctttccgcggatatcatccaaagaacaacaagtactttgggttcatcaccaagcacctcgccgaccaccggtttgcctgccacgtctttgtgtctgaagactccaccaaagccctggcagagtccgtggggagagcattccagcagtttcacaagcagtttgtggagtacacctgccccacagaaaatatctacctggagtagccgcgcagccccgccctctgcgtcccccggccctcaggccagtgccaggacagctggctgctgacaggatgtggcactgcttgaggaggggcacctgccaccgccaggggatgaggaagtgggggccgctggctcagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccatacctcccctgccagggctcgggtgctctggctcctgccttgatgaagcccatgtcctgccttgatgaagcctgtgccacctgcaagtgcccgccctgcccctgtcccaacacccaccgaagagccctgagctcaggctgagcccagccacctcccaaggactttccagtgaggaaatggcaacacatggaagtgaagtccctgttctcagctctgtcatctgcagggcttctgggtggctcctgccactgacctcactggcatgctagcctgtggcaggcctaggacctcagcggggaggaggagctgctgcaaggccctatcccagcaggagagggaggcttcctgactgacacaggctagccccatcttggtcctgtcaccctggccccaactattaaagtgccatttcctgtcaaaaaaaaaaaaaaagaaaagaaaagaaaagggagggagggagggaggcaggaaggaaggaagagagggagggagggaagggaggaagaaagggaaagaaggagggagggagggaaatagaaagaaagaaggaaagaaaaagaaagaaagaaagagaaataaaataaaaattaaaaaaccataaggttaaagtaaaccctttttcttcatacagattaaaacacatgacttcaaattacagctttgcttcttaatagcttggtgatgtaggacgttatgtaacctctctgtgcctcagtttcctcatttataaaatagggcaataataatatctagcccataaggcattgtgaggattaaatgtgaaatgctgatcacaaatacctagcagcccaatagatactcactgtaataattattatttttataatttctgcaaaagtatggtgatgattcttgggttaacctaaaggcagattttcttttatttcttcctgtttcttttcttttccttgttcactttaaagaattaaaaagaaaattgattccagcattttggaataaaaatttgcatcaaaaagaatttattcattttattgacatacaaataaaatgtcatttgtttattcaataaacatttattaaatgtctggtaaatttcagacatcatgccaggcacagggatgacaatgacaataagatgtggtctctgccctcagggagctgatagtccaggagactgacaagtagacaggtgattacatgcaatgtaacaaaggctatgatgtcatacaagaagacaagtgggagtatgtgatgggagtatggttttgaccagttcctcctcttagatttatccctttttctttggctataaagcaaaagaattggtcctatttttttttcttaactttgcaaattaaaccataaattttaataactttataaagataaaaggcaagcggtcagattcagtggctcacacctataatcccaacactttgggaggccgaggcaggtggataacctgagatcaggagttcgagaccagcctggccaacatcgcgaaaccctgtctctactaaaaatacaaaaattagctaggtgtggtggcaggcacctgtaatcccagctactcaggaggctgaggcaggagaatcgcttgaacctgggaggcggagtttgcagtgagatgagatggagccattgctctccagcctgggctacagagcaagactctgtctcaaaacaaaacaaaacaaaacaaaacaaaaagatgagcaacttgaattatggaggacactagaaatagtgtttcctacagaatcagggcttcctaccaacatagtcacttctagggttttcgacctgaaaagttctgtggcatattgtttctttgctatccacttttttttccctatttttccccctctttctctcctctactttatctcctagagatctaggtagttcccaaaggaataatgctttacggagtctaatgttgatttattaggtaaaaacagaaaatgacttttttttttacccacaagttccataccaaaaaatgaatgtaaacttcttatgcagtttcacacattgaaaatgcaggttattttaattccattgcatttttcagaattctcaatcgcaatcctctgacaactgttgaagatccgtatctctttaaattactggcattaaaatatctgtaagtactatagtactcttgggagtcatgagatgatttatactctttttaaatttttcatcaaagattaagtattttgcatttaggctaaaatgtcataatttaaattttaactgagttattgaaaaacattattggcaaaggaaaggatgtgtaatggtcaagatagccagcaggggaaagagaacagtgttgaagaacccatatagatttggaacatgtagacacatggaggaatattacttaaccaagaaagcaaaggggaaaaggtgttcattattctaaaaaggaagaaaagagtaaataatcaagatgggtgaatgcaatatgaaaatgagaagtaagataatggtaaaaaaaaaaaacagtgtaagacctactcttgaatatcattaatttgatgatgcaaatcaactttaatttctttaataagagctctctggaattttgcggcaaataaactgttgaactggcttgttttatagggaagccaaaattgaagtaatcacatgtccttgaattatctttttaagtacagaattttttactggggttcatatcatgaatgtttcggctttcttcttcagagacgtgggaacaacgcaagtcccacttacaacacttaagaacattctcatgatgaccgttgaactggaaaaactgtaagttatttttttcttagacttattttcaccctgttgcgtttttaggtttgttttattattttcttaagtcaggtttattgagatataattttcatatactaacattcaccctttttaagtgtacaatttgatgagttttgacaaatgtatagttacataaccaccaccacattcccaatataaagcatttctgtcgcctcaaaaaggtccctcgtgtccctttgtagtcaatcacctcctcccaccgtcagcccctgttagctactaatctgatttcctatagttttgccttttccagaatatcttataaatgaaatcatatagcatgtagcctcttgtatttgacttctttcacttagcataattttttcttttttgagatggagtctcactgttgcccaggctgcagtgcagcggcatgacctagactcactgcaacctccacctcccaggttcaagtgattctcctgcctcagcctcctgagtagctgggattacaggcacatgccaccacgcctggctaatttttgtatttttagtagagacgaggtttcaccatgttggccaggctggtttggaagtcctgacctcaagtgatccgcccgccttggcttcccaaagtgctaggattacacgtgtgagccacctcacctggcctcacttatcatattattttttgaaattatgctgccatccatgttgctgcacccatcactacagctggccctccatatctgcaggttcctcatccatggattcaactgaacatggatggagaatacttgaaaaaaatgaaatatataaaataactataagacaataaaaacagtagaaaatttaaaatacagtataattatttacataccatttacactgtattaggtatttaaagtatacctgaggctatatacaaacattatgtcatttcatagaaaagacttcagcatctgtggactttggtgtcggcagggggtcctggagccaatcccctgcagacaccgagggacaactgttcactcctttttattgctcagtagtattccagttgtgtggaaaccccatctctactaaaaatacacaaattagccagatgtggtggcacacacctgtaatctcagctactcaggaggctgaggcacaagaagtgcttgaagctgggaggtggaggttgcagagtctcctttacacttgctgtcctccctccactgccgcctgacacactcctccccagcagtggcctcttcataggcaaatttaaggagcaccttttagtccttgtcctgcttgacttggccctgatgtttgaaattcttgataaatctttcttccggaaacacactctttctatgcttccaggaaatctttttcttggttctccagacaacttcttagactccttgaccaattccttcttgttgccaacaatggaaacaaaccagccctacctaagcaaagcacattaaaactcactagaaagatacaggggagggggcgcccactaaaccactaaagagacaggaggtggggagctgtaggaccaggtttgggaacctgcaagaatcaagaccagagcccctgaaatagcaagaagctggaagcacaggaactgtcagagccagatggctgtcactgcagtcagcgcctctgattgtttgtttttgagatggagtctcgctctgtcgcccaggctggagtgcagtggcatgatctcggctcactgcaacctccacctcccgggttcaagcaattctcctgcctcagcctcccgagtaactgggactacaggagcctgccaccatgcccgactagttctttatatttttaatagagatggggtttcaccatgttcgtctcaaactcctgaccccaggcgatccacttgcctcggcctcccaaagtgctgggattacaggcgtgagccaccatgcctggccagtttttgtatatttagtagagactggttttgccatgttggccaggttggtctcaaactcctgacctcaagtgatccatccacctccgcctcccaaagtgctgggattataggcatgaaccactgtgcccagccacctctgatagttttcatcgtcctcgggccactggctcccaaatcacggttccagacaaaagcttacaagtagtccagctttggccaggctcagtgtgatggttaatactgagtgccaacttgattggattgaaggatacaaaatattgatcttgggtgtgtccgtgagggtgttcccaaaggagattaacatttgagtcagcgggctgagaaaggcagacccacccttaatctgggtgggcacaagctaatcagctgccagcaaggctagaatataagcaggcagaaaaatgtgagagactggcttagcctcccagccaacatcttcctcccgtgctggatgcttcttaccctccaacatcggactccaagttcttcagttttggaactcagactggctctccttgctcctcagcctgcagacggcctattgtgggaccttgtgatcctgtgagttaatacttaataaactcctgtatatattccattaattctgtccctctagagaaccctgactaatacgctcagtgactcacacctgtaatcccagtactttgggaggctcaggcaggaggatggcttgagccccagagtcttcttcttctccttctccttgtccttctcttcccttcccctttctcctcttcctcttccttctcttcctcttcctcttcctctccttcctcttcctcttcttcctcttgtttgtttgagaaaggttctccctctgttgccaaggctggattgtagtggcacaattgtgactcactgcttctcagcctcctgagagcccaggagtttgaggctgcagtgagctatgatcacactaccacactcctgcctgggtgacagagcaagaccctgtctcaaaaaacaaacaaaaaactctggtatgatagaggtgaattgtctgttttatcctgataattctgcttaccttagtcccgtggttctcaactgggccaattttgctccccaagtgacatttggcaatatctgggcagaggtcaaggacgctgcttaacatctttttttttttttttttgagacacagttttgctcttgttgcccaggctggagtgaaatggcacgatctcgcctcactgcaacctctgtctcccgggttcaagcgattctcctgcctcagcctcccgagtagctgggattatgggcatgcaccatcacgcctggctaattttgtatttttagtagagatggggtttctccatgttggtcaggctggtctcaaactcccaaccttaggtgatcagcccacctcagcctcccaaagtgctgggattacaggtgtgagccacctcacctgtcctgcttaacgtcttaaaacacacaggacaattcccccataaaaaatgatgaccagccgaaaatgtcaacagtatcaaggtgaagaaattgccataaaggcttggtaaacagggatggtatgacgacactattgataggccacattaaaatacttagggccatatccattatccctgtttttatgatttcttctttgtccccatgcagtttcaggggcaaaataagggagtaagtcagaggtggttccaaatagacatctgggaatcttagggtgtaatatggccctcatggaggcccttgctgagcttagggcctgattctggaatcctagcattgccaagagaggcaggctggcaggtgagaagacaaataatgggagagcccacatatgttggaattcatttgatggtatctaagctggggtgattgtccccactagcattacatgactatggatccagttatttggagaaatccatttcctccacagggaatatatactacattagaaccaaagatggaatccttagtaaatggaatcatttggcaaaattcagttgtctgaaatttttgcataaaattctcttttttattttcattgagccaaataaataaagtatcaggtatttactggggtcaccattctttgattcattgattttttttttcagacaggatctcgctgtcacccacgttggagtgcagtggcataatctcagttcactgcaacctccacttcctgggcttaagtgattctcccacctcagcctcccaagtagctggaaatacaggcgcgtgccaccatgcctccattttctttctttttttttttttttaattgatcattcttgggtgtttctcgcagagggggatttggcagggtcataggacaatagtggagggaaggtcggcagataaacaagtgaacaaaggtctctggttttcctaggcagaggaccctgcgccttccgcagtctttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtatagaacaaaatgaaaagtctcccatgtctacccgcctctacacagacacggcaaccatccgacttctcagtcctttccccacctttcccccctttctactccacaaaaccgccattgtcatcatggcccgttctcaatgagctgttgggtacacctcccggacggggcggctggccgggcggggggctgacccccccacctccctcccggacggggtggctgccgggcggagacgctcctcaattcccagacggggcgactgccgggcggaggggctcctcacttctcagacagggcggttgccgggcggaggggctcctcacttctcagacagggcggttgccgggcggagggtctcctcacttctcagatggggcggccgggcagagacgctcctcacctcccagatggggtcacggccgggcagaggcgctcctcacatcccagacggggcggcggggcagaggcgctccccacatctcagacgatgggcggccgggcagagacgctcctcacttcctagatgggatggcggccgggcagagacgctcctccctttccagactgggcagccaggcagagacgctcctcacttcccagacggggtggcggccgggcagaggctgcaatctcggcactttgggaggccaaggcaggcggctgggaggtggaggttgtagccagccgagatcacgccactgcactccagcctgggcaccactgagcactgagtgaacgagactccgtctgcaatcccggcacctcgggaggccgaggctggcggatcactcgcggttaggagctggagaccagcccggccaacgcagcgaaaccccgtctccaccaaaaaaatacgaaaaccagtcaggcgtggcggcgcgtgcctgcaatcgcaggcacttggtaggctgaggcaggagaatcaggcagggaggttgcagtgagccgagatggcggcagtacagtccagcatcagagggagaccgtggaaagagagggagagggagaccgtggggagagggagagggagggggaggggagggggagagggagagggagaggtgcattttcttataaacccaatttcctctttagtgcaactctaccatttgaaaggaacctttctattgtaatttacaagctgtgaataaccgctatgtaattctttccaaggattaataaactgagagaggatttgaaccaacagaggtaggggaagattagaagggggatgcaagtggccacagatcttagaggcggccagcagagggcgctgctccaaggtgaaggtcgcaccctgagaggccatccttttttgtaggaccagactggggtgtaaggacagtgcctcatcctcacaacgacagacccgtgttctgggtgtggatttgcctcccttgcctgcgggacttctgctagcactgccgttcctagacttagaccatgctagaatgagtccaggaaccgaggagaggagatgggagtggctcctcccactgtggcccctaataattcacatgaagaatttttgctttccttgccagggacccgggactcagtgggtccagaggtcctagtgccaaaggaagaaatgtgtagatcaggaaatactattatggttttattcaactggaagccgaggctggccatttattgtatttatttatttatttatctatctatttatttatttatttagagacagaatctcactcttgtttcccaggctcccaggctcaagagatcctcctaccttagcctcctgagtagctggtactacagtcgcatgccaccttgcccagctaattttttttttttttgagacgcagtctcattttgttgcccaggctagagtgcagtggcgcggtcttggctcactgcaacctccacctcctgggttgaagcgattctcctgtctcagcctccggagtagctgggattacaggcatgtgccaccgcgcctggcaatttttttttttttagtagaggcggggtttcaccatgttggccaggctggtctcaactcctgaccttgtgatccgcctgcctcagcctcccaaagcactgggattgcagacataagccaccgcgcctgttttttttgttttgttttgttttctgacagagtctctgtcacccaggctggagtgcagtggtgtgatctcagctcactgcaacctctgcctcctgggttcaagcgattctcctgccttagcctcccaagtagctgggattataggcgcacaccactatgcccagctaatttttgtatttttagtagaggtggggtttcaccatgttggccaggctggtctcaaactcccgacttcaggtgatccacccacctcggcctcccaaagtgctgggattataggtgtgagccatcaagcccagccctgcccagctaatttttacactatgggcaagtatgctgcccaagagtgctctggaactcctgggctcaagtgatcttccttcctcggcctctcaatgtgcttggattacaagcatgagccaccttgcccagccgaagctggccatttaaagttcctcatgctgctgaatcaataaggatggaaggcggctactattatgggctaagtgtttgcatcctccccaaattctttttttttttttttttttgagatggagttttgctcttgttgcccaggctagagtgcagtggcgcgatctctgctcactgcaacctccacctttcaggttcaagtgattctcctgcctcagcctaccgagttagctgggattacaggcatacgccaccacacccggctaattttgtatttttagtagagatggggtttctccatgttggtcaggctggtctcaaactcccgacctcaggtaatctgctgacttcagcctcccaaagtgctgggattaccagcatgagccaccgcgcccggcccccaaattgttttttgttttttttttttgagacggagtctcgctctgtcacccaggctggagtgcagtggcatgatcttggctcactgcgagctctgcttcctgggttcacgccattctcctgcctcagcctcccgaatagctgggactacaggcgcccgccaccacgcctggctaattttttgtatttttagtggacacggggtttcaccgtgttagccaggatggtctcgatctcctgacctcgtgatctgcctgcctcagcctcccaaagtgctgggattacaggggtgagccaccacacccggcctcggcccccaaattcttatgttgaagccctcacctccatgtgatggtattagaaggtggggcctttgggacgtaattaggctgacagtgccccatgatgggatgagtgtcttaaaagaaaagaccaggtggtctggctagtggctcacccctgaaatcgcagcactttgggaggccaaggtgggtggatcacttgagatcaggcgtttgagaccagcctgggcaatatggtgaaaagccatctctactaaaaatacaaaaattagctgggcgtggtggcgcaagtctgtaatcccagctacttgggaggctgaggtgggagaatcgcttgaacccaggaggtggaggttgcagtgagcccagatcatgtcattgcactccagcctccaacctggacagagagagcatctggagagtctctgtctcaaaacaaaaagaaaaaaaaaagaagagaccagagagcctttcttctctttgtccaccaagtgaagatatggcaagaaggcagccatctgcaagctaggaaaagagcccttgccagcacccaattgtgctatcaccctgatatgggacttcccagcctccagaactgtgagtaatcaatgtctattgtttaagccacccagtatgtaatactgagctgactaaaaccatcaccgaactagcctctttacatatgattagcaagaggaaaatggctctgttacttaatggaggaaggaggctatgtctgaaagccaaaaattcactggggacacatcttagcaggctcttgaccctaagacctggttaatggaaaagtagagcaacccaataaaaacaagaccaccaagaagtcaggtcttatggaataaagtattgagtgtccctatgaggcacagaacccttcgaaaggggattggaagaagtggtgaagaaggcggctatgattatcaacttagacttcatcgccatttgtagaaggaggcttctaacagctatgttttatgttaattggctcttttctcttcttttttctttcaaccttatattaagagcactggcagaagctagcggttttggcatcctgtaattattagctgtataaccttggccaagtaactcaacctttctgtgcctcagttactcatctgtaaaacagggtaataagtctcaacctcgtacttatgttgttataaagatttaacactaggctgggcatggtggctcacacctgtaatcccagcactttgggaggccgaggagggtggatcacctgaggtcaggagttcaagaccagactggccaacatggcaaaaccctgtctctactaaaaatacaaaaaattagctgggtgtggtggcacgtgattgtaatcccagttactcgggaggctgaggcaggagaattgcttgaactaaacctgggaggcggaggttgcagtgagccaagatcgtgccactgcactctagcccaggcaacagagttagactctgtctcaaaaaaaaaaaaaaaaaaaaagtaacactttgaacaaaaaagaaaaaaataataaaatttaaaaaagatttaacaattgggccaggcatagtggctcatgcctgtaataccagcactttgggagcctgaagagggaggattacttgaacccaggagttccagaccagcctggacaacaaagcaagactttgtttctacttaaaaaaaaaaaaaaaacaccaaagtcaggtgtggtggtacacacctgtgatcccagctacttgggaggctgagatgggaggatcccttgagccttggaggttgaggctgcaatgagccatgatcataccactgcactccagcctaggcgacagagtgaggcccatgtcaaaaaaaaaaaaaatgatccccaacatttagcagcttaaaacaaaaaacatttattatatcacactttctgtgggccaggaatctgggagggacttagctgggtggttctgctcagttctcttgggatgtttcagtcaagcagtggcctggggctgcactcttatctgaagactcaattgggagaaaatatgcattcaaggtcactcattggttgttggcaggctgtagttccttactgaatattggttgaagacttcattggcttactacctggacttctccatagactgcttgaatgtcctccccacatagctagagtgaatgactaaaaaagagagagaacacacacagcccaggtaagagttcagtctttctaagtcattatatgaaagagattcttttttttttgagatggagtctcgctctgtcgccaggctggagtgcagcggcacgatcccagctcactgcaacctctgcctcctgggttcaagtgattctcctgcctcagcctcccaagtagctgggattacaggcgtgtgccactatgcccagctactttctgtatttttaatagagatggggttttaccatgttggccaggatggtcttgatctcttgaccttgtgatccacctgccttggcctcccaaagtgctgggattacaggcgtgagccaccacgcctggccgaaaaagattcttgcacacacatgtttatagtagcactattcacaattgtaaaaatgtggaaccagtccaaatgcccatcaatcaatgagtggctaaagaaactgtggtatagatatacagtggaatactactcagtcataaaaaggaatgaattaatggcatttgcagcaacctggacaggattggagactattattctttttttttttttttttttttttttgagatagagtctcacttggtcacccaggctggagtgcagttgtgcaatcttggctcactgcaagctctgcctcctgggttcacaccattctcctgcctcagcctcccaagtagctgagactacaggcgcctgccaccacgcccggctaattttttttttgtatttttagtagagaccgggtttcaccatgttagcctggatggtctcgatctcctgacctcgtgatccgcccacctcagcctcccaaagtgctgggattacaggcatgagccaccgcacccggcctattttttttttttttttttttttttttttttttttactaaccaggggtttaacataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaataaagaagattcatgctaagctgtggcagaggggggaaggtatgatcgggtgggggtgggataaggaatggccatggaagataactgggtcaggttggaccctgggctgggagggggagggcaaggcccctcaccacaacttaagccaaacctaagctgcccccaggtgccataggtccctgtcccagcagggaggctgatgggcctgggcccatgcccctccccacctttgggggtcagatagtggccacccaggtttgctgggttggggcctgatacaggctctgcatgcccattcgggctgcctgtggagagagaatggagtcactgtttaaccatgctacctgcctcagccccagcagaccacaggaggttggccccagactcactgagtgcctgcagcagccctacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttgggaccctaacttgtcccttgccaaggccaactggctgccctctggctgtggggaccgcaaggagggacccacaagctgctggcgaagtcgctgcttcagttctggcttgagccactccacagccacctgctctccacagaggtgtggctgcccttcctccagggcctttttggccatggcagcggtccagtgcgagctgaatttgagcagagcgatctgcccgggcgcaggtccggggctgggcagcagccgcgcctcctgcaggccgggacccagcggctgcagcgcgggcagcagcgcgggcagcagcgcggtgcgggtcagattcggcggcaggcagtcaacgctcagctcacacttcccggtgctgcggcacacgagcagcgggcaggacggccgcagcgggtggttgtgcagcgggcgatggcggcctgcgcgccgcgccgcgagctgcagcgggcatatgcgaagccgcggttcaggccgctgaaggtcatcatcaggcggaactcgtagaggcggcccacgcgctggaacagcaggatagctggtgctcatacacttcctgaggcagccgcccgatgaacacctctgacccagccggcggcgggctgcccacccagcctgggggtggcccgccatacttcctctgcccgttcacctgcaccaggcgatgcctgtctccctgacccacgcctccagcgccgccttcaccctctcacaccacagctcacaatcccgcttggactgcatggctctctattctcttttttttttttttttttttgagacgtagtttcactcttgttctccaggctggagtgcaatggcgggatcttggctcaccgcaacctccgcctcccgggttcaagcgattctcctgcctcagcctcccaagtagctgggattacaggcatgcgccaccatgcctggctaattttgtatttttagtagagacggggtttctccctgttggtcaggctggtctcaaactcccgacctcaggtgatccacccacctcggcctcgcatagtgctgggattacaggcatgagccaccgtgccccgtctatggagactattattctcagcgaagtaactcaggaatggaaaaccaaacatcgtacgttctcactcataaatgggagctaagctaggaggatgcaaaggcataagaatgacacagtggactttggggaatcagggggaaaggatgggaagggggtgagggataaaagactattaattgggtgcagtctatattgcttgggtgatgggtgcacacaaatttcacaaatcaccactaaagaacttacttacgtaaccaaacaccagctgttccccaatatcctatggaaataaaaatttttttttagaaaaagagttcggtctttctgtaacctaatcttggaagtgtatattatcacttcttccataggctatcagtctcccagaccaaccctgctacagggtaggggagactacatggtatgtgaataccagaaagtgggggccactggggactggctatttggaggatggttactacaaactatatttgtaattttttttttcttgagatggagtcttgctctgttgcccaggctggagtgcaatggcacgatctcagctcgctgcaacatccacctcctgcgttcaagtgattctcctgcctcagcctcccgagtagctgggattacaggcacgcaccaccacacccagctaattttttgtatttttaatagagatggggtttctccatgttggtcaggctggtctcaaacgcctgacctcaggtgatctgcccgcctcggcctcccagagtgctgggattacaggcccgagccatggtgcctggctatatttgtaatattttaaccactaaaaaaaaaaaaaagaagaagaagaagaagaaaaagaaacaagtatgggaaaatattaagatctgataaaaccgggttatacttatgcaggtattcattacattattctccataactttttaaatgtttaataataaaagtaaaaatattttccccttaaaaatgtgcagagcatacctcaaataatgttgacaaagaatcctaaagacaattattattattattattttttgagacaggttcttgctctgttgcccaggctggagtgcagtgatgccacctgagctcactgtaaactccgtctcccgagtttaagcaattctcctgtctcagcctcctgagcagctgggactacaggcgagcaccatcatacctggttaatttttatattttcagtagagacggggtttcatcatattgcacaggctggtcttgaactcctggcctcaagtgatccacccaccttggcctcccaaagtgctagcattacaggcatgagccactgcaccgggcctctcaaactcctgacctcaggtgatccacctgccttggcctcccaaagtcctggcattataggcgtgagccactgcgcccggccgatcttccttcctttctcccttcccctcttcttcttcttcttcttcttcttttttaattaatagagatgggattttgccatgttgcttaggctggtttcaaactcctgggctcaagctatctgctcgcttcagcttcccaaagtcctgggattaagggcgtgagccactgcgcctggccccagtaaggatttaaaagctcaggaattattagtcagcttccttttttgttcatcctgttgtttgttcatttcagtctattccctttttataatttccttcttcataaggactatttctccttgtacttttgtgagaattcccgtaacttgtaatcccagctacttgggaggctgaggcaggagaatcacttgaaccgggaggcggaggttgcggtgagccgagatcaagccattgcactccagcctgggcaacaagagcaaaactcggtcttggaaaaaaaaaaaaaagaaaagaaaagaaaaaagaaaggaaggaagatcctcattggacagagcaaaaagcagaattgatggcactgaaaatgaaatcagcagctgatgtacaagttccagaatgtctcctagagtaacaaggaaatccgggtgtggtagtttatgcctgtcatccaagcactttgtgaggccaaggaggttagttagcttgagcccaggagttggagaccagcctggccaacatggtgaaaccccatctctacagaaaatataaaagttagctgggtttggtggtgggtacctgtagtcccagctactctggaggcgaaggagggaggatcacctgagtcccgcgaggtcaaggccacagtgagccttgatagagttttgccactgcactccagcctaagcaacagtgagaccctgtctcaataaacaaacaaacaaacaaataaataattgtagagacagaagataaaatggagcccggtgcagtggctcacgcctgtaatcccagaactttgggaggctgaggtgggcagattacttggcccaggagtttgagaccagtctgcccaacatggtgaaaccccgtctctactaaaaatacaaaaattagccaggcatggtggtgtgtgcctataatcccagctacttgagaggctgagacaggagaatcgattgaacccaggaggtggaggttgcagtgagctgagatcacaccactgcactccagcctgggtgacaaagccagactctgtctcaaaaaaaaaaaaaaaaaaaaaaggctgagcacggtggctcatgcctgtaatcccagcactttgagaggctgagccgggcagatcacctaaggtcgggagtttgagaccagcctgaccaacatggagaaaccccgtctctgccaaaaatacagtattagcaggtcgtggtggcacatgcctgtaatcccagctacctgggaggctgaggcaggagaatcgcttgaacctgggaggtggaggttgcagtgagccgagattgtgccactgcactccagactgggcaacaagagtgagactctgtctcaaaaaaaaaaaaaaaaaaaagagagagagacagggtttcaccaggttggccaggctggtcttggactcctgacctcaagtgatctgcccgcctcagcctcccaaagtgctgggattactggtgtgggccactgcatctggctcccaccatctctattaaaataagataaaataaacataaaataatgaaccgacaaaataataatacaattcattgtaagtaaaatgctatcctgagttctgtgagtcattctggataattcaaattctctagaattaccacctcagctgactttttttttttttttttgtagagaccaggctggtcttgaattcttgagctcaagtgatccgcttccctcagtctcccaaagtgctggaattacatgtgtgagccactgagcctggcctacaaattctttattatacaacacacagtagatgctcaataaatatttgctaagcagaaacatacactcaaaataccagaaattatcaaggaagttgccagttggtctcttgggttcttcctcccgacaggtatacacacctattgtaaagatgaacacattaggctgtgagaaaccaatactgttaaacattccaatcaggtgacaaactccctgggctctggtttatattaccaagcaacctgatgataacttggcttcctgtgtggcttgtttatagaaagagaatgctacccaggctgacgtgagttgcatttctgagttgatttctcactgtaaattaataaactggcattctggctacatagatcagtctctttgaactctttgtaccttccaccattagtgtgatttctaaggctgcaagccagacactgcccaagacccagcactggactctggtgagttcttccagctgttgccaccccaggaggctctgggagcccctgggaaccatccagcttgctctctgtctctacatttcagggtgtgggtttcagggcattcacaacattcctgcaacagaagagttttgggaacacccccagcaggatgtgggtgatttgaatgtatgtcagagatgtggttgtaactgagaaatcttaagcctagtgaattttattccacttgacttaaataaagagcacgtgaaagaaggggatctgaggacatctatgaacagggccccgagggcatgaacttactagtgtttatatgactagtgtttatctgggcctgtctagtctggagaacctgactctggtgtacccaagctttgcagtggctgtagaggtttgctcttttggagggagaagataattcattcctccaacacctgaatgagggtagattaacccacctccttcagctgcaatttggcaaatttctcttctttgatttaatgctcaacggacaaatttcctttcttcttcttcttcttcttcttcttcttcttcttcttcttcttcttcttcttcttcttcttcttcttcctcttcttctttttttctcctcttcttcttcttcttctcctccttctccttcttctccttcttcttttctcttccttctcctcctccttcctcctcctcctcttcctactcttcttcctcttcctctcctcctcctcttcctcctcctcttccttcttcttcttctttctttttttttcggttttgagacagggtctccgtcacccaggctggagtgcagtggcacgatctcggctcactgcaacctccacctcctaggctcaagcgatcctcccacctcagcttcccatgtggctgggaccaaggcgtgagctaccatgcccggctaatttttgtattttttgtagagacagggtctctccatgttgctcaggctggtcttgaactcctgagctcaagagatcctcctgtctcaggctcccaaagtcctgggattacaagcacgagccaccatgcccggcctcaacaggcaaccttctgattaataattagacctctgtgccggccgtcgtggctgatgcctgtaattccagcactttggaaggccaaggcgggtggatggcttgaggtcgggcgtttgagaccagcctggccaacacggtgaaaccccgtctctgctaaatatacaaaaattagcctggcatggtggcgtatgcctgtaatcccagctacttgggaggctgaggcacgagaatcgcttgaacccgggaggcagaggttacagtgagctgtcatatataatgaaacagttttactaaacttaggaagcagtgacttggtgtctctagaaattgcctaacatacacattccaggatacattctctgtcatctggaatctcctcccttccacaaacccacgctgtcttaagcactattttcctatttgttgttgacctaatctagaaaaaagcggccatcactctttctcccccactcagtccctcagtcccgaaacacccttattctccgcacttgtcaccccaccctctgctgcccccaccgcagcgcgcaaacgcacacgagtttaaagtttaggctgtgatgctatcctcgcccgcagatcacaggacagacattctcggggacaactttgcgaggccatgtgctcgtcccccttaggaaggaagagggagaaatccctgcggctcggttttgttccaatggtctgctcagcgagtgattcccgtttccccaaaggctgcccctcattagcatgaacggggacgcgggtgtggagaaggggttagaggagagaaagcaagcaaaagcccaggctcacttttagagcctgggaaccctgtctgcaaaaatgacagctagagctttctggctcctctgtttaatcgtcggatcatcccccgaagctccggtggagagaaaaagtaagatcggtgtagtgcggagccctgggagcggagcggggatctggggagggggcgcccaggcctcagccgccggccgacaaccgggccaccttccgtgaggccgcacacgctcccacaggcccgcgcctggcgcaagccgagaaccgcgcgtcgccgcgccgcgggcccgcgacggaggaagccccgagacgcgcgcgctcacgggccctacgcttccccgccgcccggccgcgcgcgcgcgccgccgagggccccgccggccctgcccaccccaaccggccgcgcgccgttgtgccggcccccggctcgccgcccgcgccgccgccgcgcctcagcttcagattcggcctcagtcagccgcgcagggacgcggagcccggcgccgagctctgcgcttgcgcttgccgggcgggcatggacgggcgagaggcgttctgcaagcgcgaaatcggtgagcccggccgccgcgccgccgccccgcgagcctttccgagtcccggagaatcctgcacgcgagatcccagggcgcccgacccatgcgggccgtttcgctgttgctaaaaaccaacgcccagggactgggagaggaactggggttcccaaactgttttttggaagcagcgatgaacgggatagtgcatgacgtggacgtgctgggcgcgggcatctggctggtgaccctgctggtggatcgggacgggctgtacaagatgaaccgcctgtacctcactcacccccgacgtcttcttcttccgagtccacatgttagtcctggactcctccagctgcaataaaccgtgtccagagtttaaacctggtattgaaactgagctgaatgacgctgcatatgtactttataccaccgtttgtaacgtgggtgccacagcccgggctgtgggtcgtccagtctttttttgggacggatgggggacagtattgtaacatgattaggatttagacgacaggtattatttccgccactgtgatttaagcaccgtcagccccacccccacgggtgagaacggcagctgttggcacaaagcgggctgtcaataaatagatgttgacaaatggagtgagcgaccaccaaacaccattgccagaagggactgtacagaactgagtttagaaaagctgcttttttgggggagtgtgtggagggttggtagcggggaatacccactcccacatcttttttttttttttttttttttttttagacagagtctcgctctgttgcccaggctggagtgcaatggcgccatctcagctcactgcaacctccgtcccccaggttcaagccattctcctgccctcagcctcccaagtagctgggattacaggctgagccactgcgcccagccccactcccacatctttctaggcatgtgctctgggaaatcctgatacaatgtgataaggacctttgttctgtaatgtgggctggttacgtattgctttcccttccccacaccccgtgctactttttgtatttttagtacagatggggtttcaccatgttggctaggctggtctcaaactcctgacctcaagtaatctgcccgcctcggcctcccaaagtgctaggattaaaggcgtgagccactgcactggcctggttgggttggttatcttctaaaggtcgctagactgtttccaccttgcctgtagactaaatatcagtttcaacttgtgcagcaagatagtagattgcagcttaggtatttcttaaaggccttatattttctgtttcatggcatttaaaagacgctatgaattaatgttctggttattttgtccaggcagcaggtatattgtgatgggccacatctaccataagagagggcagcttcctacagctctgctccaggtcctgagaggccatctctgtccaggggatggactgctgaggagcagcagcagctatgtgaaaaggtttaacccaaaaagggaagggcaaattcaaggtgcaattcatacccaatgcatttgaaacaaccatcctggcatttctggatcacaagagacatcggcaacaagacatgaaaggtctatcttcatgtaatgggtcctcctttagaagagagcccaaagctactctatgaatgacctgcatagttacaactgtaatctcgaaggtgtcactttgttatttacaagatgcttcttaaatgggctgctcctgagctcagtgtcaaggtgattcaactgttgtgccagacagtgatttacacagctcagataactgacctgtctagttaacagatcactgcttcatgtttttaaatattttaatttaatacattctttagtagaaatagtccacaaaacattttcctgaatttaaatacacaacttttatatcatgtatcaaacctgattttatattcaaacctgatttatattcaaaacttatatgtgaagattaaattcttcacataacagtaagcgcactagtcaaaagacatttacctatgaaacgtcatttagatcaaacacaagggtcaaagcccaggacaaggattaaaattttacacttaaaaagtaccaagccgggcgcggtggctcacacctgtaatcccagcactttgagaggccgaggcgggtggatcacctgaggtccggagttcgagaccaggctgaccaacatggaaaaaccctgtctctactaaaaatacaaaaattagccgggtgtggtggcacatgcctgtaatcccagctgagggaggctgaggcaggagaatcacttgaacccaggaggcagaggttgtggtgagccgagatcgcgccagcctgggcaacaagagcaaaactccgtctcaaaaacaaacaaagtgtacaaaagggccagtgtgcggatgggtggattaaaaaaataaattttaaaaaagtgccaaagggcttacttcaggcaaaagtgttcctgatgtaccaaagagtaagatatagtttattttcatgcctccctgctcctaataatgtatgttttgtgctgaactggcagctatcccaatgtgaactgtattctgagtgtatctgatatcatttttctattaagaccaagtataatgtttgcttgtaaagcaataaatcttgctttgaaattagaccttggatgcacctgtttatttttgttttgttttgttttagcctttgagccctaaaggtttgagaaaaagcctttctcaaattcattccccaaaccttggaaccaatattaaccaatgacagctcacaagcaagtgaattctaaacatttttcagttggttttaaaaaggtttaatcactagctaaattaaatattgattttatacctgagtccacaaagacatgagagtattttttcagaagataaggctgtacttcagtttataagaagtacggtgaacagagacaccactaatgcatagatgaagatgactgcctaaagagagacaggggaaggaatttcactggagagagagcagcctatttggcctcacggtgatgcactcaggaaggtcagaatgtgtcctgacgctgtccatggcacccagtagtagcactgtacacataaaggacatccaggacgggacgctagggaatcacaggagccaagaggcaacagcctaacattacaatacctgatactattatttgttccaattatggggcagacaggtaataaagagttgagaggttctgagtgttctatggtaaagcactactgagagatttctagagtattttccaaaaatgagttttgtccaaatttattataaattttactagaattgctttttgggagtcagatgcattattgcatgatagaattatagctaatgaagagcttctgagctagttttctttaagataaaaaaaattaactcaggcataactcaggccagtcaaatcaaagttgaatttttaaatgtcaaaaggctaggccgggagctgtgactcacacctgtaatcccagcactttgggagaccaaggcgggtggatcacaaggtcaggagtttgagaccagcctggccaacatagcgaaactctgtctctactaaaaatacaaaaattagctgggcatggtggtgcatgcctgtaatcccagctattggggggcaggaggatcgcttgaacctagtaggcagaggttgcagtgagccgagatcatgccactgccctccagcctgggcaacagagcgagactctgtctgaaacaacaacaaaaagtatatctatatggctaatttctttagttgaatttggttcaaattggatcaagtggtataatcttctaagaaaagtcttttagtatctcactccaagtatctagaaataccttagaatgtttcaaattattaaaaatacttctcggttggctcttccctccacctcctcaagtacttcattattttatccatggaatatccccattctcacattaagggcaagaaatctgagacctatggtaatagtttcttttttttttttttttttgagaaggagtttcgctcttgttgcctaggctggagtgtaatggcatgatgtcagctcaccgcaacctctccctcctgggttcaagtgattctcctgctctagcctcccaagtagctgggattacaggcatgcgccactttacctagctaatttttttttttttttttttttgtatttttagtagagatggggtttctccatgtttgtcaggctggtttcaaactcccaacctcaggtgatccacctgccttggcctcccaaagtgctgggattatacgtgtgagccaccacgcccagccgtatcatgatagtttcaatcaggaagagtgaaagctgtaataaccatgtaactttgtctaactaagtgtgcagagatctgaaagtccaccaggttggctctttaacataaagaagtagagagtttgcctaaaggaattagcagaaatagggaaataacttttatttgcagatcccaggaaggtagattacaaacaacagcaaatcttagtgtctctaaataacactctaggccatttggaatataaaaaggtaattattttacttcagaaaatatctccaaaagttcactttttttttgagacagagtcttgctgtgtcgctcaggctggagtgcagtggcacaatctcagctcactacaacctctgcctccccagttcaagccatcctcccacctcagcctcctgagtagctgggactacaggtgtgtgccacttgtccagctaaattgttgtatttttagtagaaacagggtttcaccatgttggtcaggcaggtctctaactcctgaccttgtgatctgcccgcttcagcctcccagagtgctgggattataggcgtgagccaccatgcccagccacaattttatttaaacctcctgtagaatttggataggagaataaaagctttaccaataggaaaatacttttcatgaaatggtttcaaggattgtgaacttggcaggtgaagcataacagttattgaaaatacttttagccaaggaaatctactgatgcaaattaaatatatttacaagcccaaggcctgtggtagaaacatcctaagagtatcacaaatgtacagtttactgcctggattattgaaagcaaaatagctgtgttatatagatcttaatagcagaagctttcaaagattactcacagaaaagcagctttcagaactcattatgttctaaaaaatgtatgtttttctttcttttttattttttttgagatgaagtctcactcttgtcccccaggctggagtgcaatggcgtgatcacggctcactgcaacctccgcctcccaggttcaagtgattctcctgcctcagcctccctagtagctgggatttcaggtgcctgccaccatgcctggctaatttttgtacttttagtagagatggggtttcaccatgttggccaggttggtctcaaattcctgacctcaggtgatcccccctgcctcggcctcccaaagtgctggggttacaggcgtgggccaccacacctggccaggaatgtgtgtttttcaaaaattacttttgaaagactaaagccctatagttgataaaactataaaatgtctttatgtatttgtatggtgatagaaactgtaaaacactttataccattaaatacacatgaaattaatatcttcctggtctcaggatttccataaaatttaccctttttaatttggcaatgctaacagctacagaagacatattaccaccaaccaaccgttgcttcattagaaactgcaccaaatccaatgtcaaaaacattactttatttttctagtatgaaatgtcctattacatacaaaagaattgctgtttagaatttgccacaatttgttgaaaacatagcaatctattgcctacaggtaggaaagttcttgctgcaacaaattttaaatgattaagcccatatatatttctatatatatgaataaatagtgcagaaatactgtgacgtgatgagatgcagaataattttataattcattaaaatgtagaattcttgcatcagcacagtgcatacaatatgtaactttttttaaaaagtaaaaggacaaaataatccatatttaagtatttccatcttaatattttaagcaaaaatgttttcatgttttcatattgagtgattagtctctttagtttgtaaacataggtttaagtgacatcttcatgtacaaaaaggaatgggcttcattagataaaattaagccagaataacctgtacacctgagcctgtaataagaaagaattgggaactgtagcaacatctttcttttaagaaaccaaggtctgggaaaggttttgcatagcagggaaacgttgaaaggaaggaaacttttaaaagcaataattagataaattccagaagttgataggacaaagctaatatgagttagaataaaatctagtagaatttttgcaaagctgcataatccagctatggcagattttatagaagctattaccacaatgcagtaatacaatgtgtaagaacattgaaaggaagaacatgcaaaatacatcttcctcattttcttcctactgcttacactacttttccttacatggaagaaacaaacaaaccaacaagcaaaaaacaaacccaatcaacaaataacacagaggatgagatcatctaacaaaaaatgtccttcatacaatataagtagctgtctgtaattggtaatttgcccagtatcacagaatgtacagatgaaggcaatgtgtatcttgtcgcattacctttttcgttagtatgatcaactgatgcgacaggattagcacccctgaagattcttctctgacgtgatgacaattgactgggaatgataaaacgaggggccactgctgtccaggagaattccaggtacaattagattcttttgcctttcatgaccttgcagccctccctccccacagaggcttacagataatcattagcacacattcaaagacacctctgtctgtgggagaaaaactatctccatttattttgtttcacatacatccatagttgaattttaatacaaaaagaaaaattagaatctgacaaatgtttacaaagaagataccttcaaatagattttactcatttcaacctggtgtggagtaattgacaaattgtactgttatattcaagtcaccagagtctgtagtccaggaccacttagcccaacctttatgcaagcttgattttaatctaccatgaacaataaactcattgttgattcgcagttgtgtgtgtgtgcacatgtgtacatagcagctcctttcatagaaagaaaagacatctagaggttgtcttgtacttttacgtacaggaatcattgataagatatggatggattatatgtaaccgtggctggattttataagaaaaaataattagttgacaaatgagggcagcaataaaaaagcatcttttttgcaacaataaataaatacagtcaaaagttttctttgagactctaaaccagcttcttcactgaagagcagacgtggcatttccatggagttatacttgaccccacagtatcattgtttcttgctttctttttcttttttttttttaataaacaaaattttctcgcttctgccacaataataaaaccatttgatcttgacaagataatggtgtcgttgacttttcttttttctttttcttttcttcctttttttgtttttgaaacggagttttgttcttgtcacccaggctggagtgcaatggctcaatctcggctcaatacaacctctgcctcccgggttccagcgattctcctgcctcagcctcccaagtagctgggattacaggcataggccaccatgcacagctaattttgtatttttggtagagacggggtttctccatattggtcaggctggtctcgaactcccgacctcagatgatccgcccgccttggcctcccaaagtgctgggattacaggcgtgagccaccgcacctggcaactttgcttttttcttgtccattggacaaaattggccaataatataattggactgttatgaccaataaaaacaaagtttaggtcaagtcttgtcaggatagcctcactaaaaagatctggctccttaatttaaaatagttcaggcaacaagattcttgctgtgttttatgttaggttaacatgctgaactttaggaagctgtagactgcagtttgttgttgtgagacctacagagtatagaaaaagggaacaattgagcacctttcatttttgaaaatgatgctttatgcggatgccaaagtaaataaatctggaagaagcagccatgttctttcattcacccttggcaagcgaatagaaaagaacgattaagaaatttttaacctataataataaaacttttcactgtacactaagcataatagctcactggaaaaagccaatatttaaaatatgtatgtatatatatttgtctaataaagattacaacattttcaggcaactggacaaatagagacatttacagaagcattaccattgtggtgaaaggtgcgtgtgtgtgtgtatgtgtgtgtttatttacacggatgaggggaatataaagggaaaaattatgctaaaacaaaagaaaaagcaattttaaaatcatatttttctattaaagtccagaaagtctcccagtttcacacagttttattcacaattttttttttttttgagacgaagtctcgcttttgtccccaggctgtagtgcaaaggcgcgatcttggctcactgcaacctctgcctcccagattcaagcgattctcctgcctcagcctcccgagtagctgggattacaggtgcctgccaccacacccggctaatttttgtactttttgtagagacgaggtttcaccatgttggccaggctggtcgcaaactcctgacctcaggtgatccgcccgcctcggcctcccaaagtgctgggattacaagtgtgagccaccaaggctggcctcacaacttttgtcagtaaaccaaattactgtacagttaccaggactaagtcaaaggactttatattgcaatagcagataaatttatattgcaatagcagataaatacagtattccaatagtttacaatttttaaatacattgtttcacgtggctgctagaataaattttttaccactatacatcgttaacattaaaaaattatattagctaacctgactttttggggggcaattttggattacgtaatcacaaggtacaataaaacagtgaccccaacatccagttctgattccagttaaaaatttagactaaagatatcacaatccgtaagaaaagaaagaatatggatggtataaatgatgaattataacaaagtgcagtaatgaaaacaatgtgcaaacaatgctggagatcataaattacaatgggaaaatatggcaaaggaaattctggaaacccataataaaatcaagtttcaataactggctagttatgtttcattctaccttaaatctggaaagcaatagaaattccctaaaaatgcaacagcaagttgtctttatacaattctttgcattgtaatttttttctttttttctttttttttttttttttgatttgtttgttttgagacagggtctcactctgtagcccagtctggagtgcagtggcacaatcatggctcactgcagcctcaacctccagggctcaggtgatcctcctacctcagcctcctgggtagctgggactacaggcacgtgccaccatgctcagctaattttttgtattttttgtagagatggggtttccccatgttgcccaggctggtctcaaactcctgggctcaagtgagctgcctgccttggcttctcaaagtgttgagatcacaggtgtgagccactgcacacagcctaatttgtttatttaagcagaattgagcaaacgtctccattcagctcccatgtgctttattgaaaattatgtcaacttcagtatattaaaaagctacataaaataaccaggtggcaagaagacatcctaagtggcccctacactatgcgggcc

SEQ ID NO: 29 - DNA, 198083 bp, Homo sapiens
agaaaatattccttgatttgctccatgactcaaaaaaggttcacccatgaattcagtctccagttcttttgctcataggttgggtccttttagaacaacttagttcaataatatctgtactgtattcaagacccaagcagatatatactggttctgtcaataaacaatcatcctgtttggaaataaagcaaaaagactatgtatccttgcagtgtaccactgggacattacctaacaagcccacccaggaaacatctgactctccataaattatttaactttgttttacctactatctataattgattagggcccagaagtcttactggatgtttattttagaacgctgacaagttaaagttggtttgcatcttgttgaaaacaatgtccaaagttacagctttattgttctataggatattaataacttttgtatgctactgagtaatcatattcctgcattcttcctttttatctggtattaaaatactgttaacagtttggccaccatcatgattcccttgttattcagtaaatcactatatatttaggaattatgtctaggctggtgcagtggttcacacctgtaatcccagcagttttggaggccaaggccagcggattgcttgtgctgaggagtttgagaccagcctgggcaacttggtaaaaccccatctctacaaacaatacaaaaattagccagacatggtggcacatgcctgtagtcccagctacttgggaagctgaggtgggaggatcacttgaacctgagaggtagaggctgcagtgagccaaggtcgcaccactgcactccagcctgggtgacagaataagaccctgtctaaaaagatggaaagaaagagagaaaaagaagagagaggggagagagagacagagagagagagaaagaaaaagaaaagaattatatctaatgttttgaaactatattttgacaattctaaagacgctgatttttttgttaattccagctgagtttcagaaatgagaataaaaaaattaaacataacagaaaatacctctgacattattatttttaaactacaagtcttcaaatatatttttgggtaataaacaagcacagtccaggagtttgaggctgaagtgagctatgattgtgcgattacactccagcctgggtgacagagcaagagcctgtcttaaaaaaaaaaaaaaaaaaaaaaaaggaataaatacacctacctccatttggggaaaaaattaacaaaatggaaaacaggctggttacatgtgggtatgaaaacctacagttgccctctgtcccgggcaacctaatttttttttttaagcaaaactgagaaaagtcactttcctaaaatttaaaacaaaacaaaacaaaaaaacctggggaacaaacaagcaaagttaaatactgccttcttatacagaaaaactttgcctggcaattgacatacgcacagctttgcaaatatttggcattttaaaaatttaagtcaatagcttttaagaaacatatgctctgcgcccattctactaataataaacaatggaaatgtattgtccctgctccccccaccccaccccccaacccctgtcttctcttaatactttctgaacgcttttcagaaagcatggatatattcataaagggtagataattcacgaaaacagggaaggggtaatctctccttgacaaaatagtgacagtgtatacttagttgttttcattatttattttactcaatccaaaaagcattctattgcacaatgttgaaactagtatggccaacacaaagggaaagatggtcttgaccttcaagaatcttacaatttaatacacacacaggaatcttacaatttaacacacaagtaaatgaatgaagggtagggaaaggaccaagctcctaaagagtgtgtgtgtacaagtgaatctgtataaactgtctcacaatcactgtggattttttaagacaatgaggattagtaacacaatggaggactgttatgccctgtccttcagaagtgctgaggtaagagaaaacatgactacagggagattactcaaaaaagtttggaatccctaaattctatatacaaatatataagtatctacatagaacttactcccctatcacatatgcctcatgtttcatgtttcctgtacccataccaccaatgtatctatgtttcctttctcacttaacaatttttaccctgattagaccattcactaaaagtttcattaataacttaaaaaagatctgtaaacagcatgcaatgaacttatattatagacttaaatagtggcaaaacttggcattctgctctttaatttattcaaaactactttccagttaagaactatcaatcttctagtgtcttcacatttatctctagcaacagtggctggctttcaaaattaggtgagagatctttccaagatctaaacatctccaatatctgcctcagagaaaatttagtttccaccacatcatgcgttcctgctaacaatgattaaaataaataaaagaactataaggttggtttatttgcggatacaagaacagcttgcttaactcaccatttaaaaagccatcacttcacactagctttattatctgaagcataatcaaaataataaactacggttgtgggactttggaatttctaattaagttatggagacttaaatcaagaaatatgaatattcataaaacccagtaaccttttaggcaaagtaaaaaagtgaaaagaacaagtgctcttggaattcagaaagaaaattaactatggtattgagagaaaccaggaaagagaaggaatcacagtagagctaggatacagaaggaaacagaaaatgacagtttaatgctcattatagaataacagtgaatcacccacagagaccattttcagtgttcttgtgaatttaacctctagtctaaccttttaatgaaaaggctataatatattagagtggcccagaaaggtgaccttatgtctcaggtgtcagagccacacccaggtctcctgattcccaatgatactccctaaagccttacttgctctggctgtagtgttttgagaattggagctgcttttaatcctatggtcagctacacagctgcaggatgggccctagattccctattcaggaattcagatcttaaaacaccaaaagtgataaaagtagatacagttccccttcttcagccaatgcaaggatcctagttacagagaaaaaacggtgtgccaagacaacacccttaattctcacgcatttccccctttctatcttttatacttaccaatttatcagtcccatgatctgtcttcacctcagaactaagtggaagaaataagtctgttgtatgctctgggggaggtacctccccaagaactatcaacccctgcaggatagagaggagaaaaatagcataagtgagcagtataaacttcaaatttaatttaggagttaagtctcaaaaggactgttggtgtactagaggccccctcttcctcaccctatggttcagaaacaaactacagcagcagcagctttgttttcccaaagagctatttcaacaagcagcagacccaggctcccctctctgccacttgactgctctgacctacatggctcatcagccatttagcatctttattcatatctttcagatatgaaatctttaccagattatggcatttataccatattactagactccactagattaacagcagcaatgcagtttttgtagccaacaaatgcagtttatgacttactaagctgaaaatgctactattcttaatcatgtactccaccaactatacctgcacaaacaaaactgaatgaaacaaatgtggaacagtcccctacaatttatgagaaaccaagagcttcttaaaagctggcccaaaggaacctgcttttttcataagcataaatattacttcagattaagttcctgcttgacaatttcaaattcagacctttggaaattcattccaggaaacaatttacataaaaagaaattaaaaatgaacccacaagtcctccccattgtacatataatgagccaggatgggtaaaggcagaaggtatcttattattaaaaaaacaaaatactacatatgaatcccaccatgtataccagaagaggtgacaaaaataaggctatgacactatataaccgaaagactgggatgcaagtgatcagggttcccaatctctttctctggtctaaaaaatagagatctaactagattaagaagctcttaatggaaatttattatcagaatcacctggggaaccttatcaaactatactggcttaggtccaacatctactcagtacctctgggggtggggccaggtagtctacctttttatgggggaagggaggcaggacatggtgggtacatggaggtgggtgtctctctcctcccccaccccgccaaccccactatgttaccgaggctgatctcaaactcctgggctccagcaatcctcccacctcagcctctggagtagctgggatgacaggtgcctaccaccatgcccagaggtggatattctactattctttaaaagctcccctggtaagtcctaaacttgtaaagttgaaaaacactagacttgattagtttgggctcaaagaacatcctaaagtatagatttgggggactagggattgtgactattagtcttagctctctaggccatacgacagactcttatgagccactaaaccagatgatccatccctggggtccttgtaactaaaaaaccaatatgaaatacaagctgcagaaaaggggaaaacattaagaaagaaaaatggaattttatttcagtttttaaaaaagaagtatgtatctctttttctcttgaagcaaaagaagcactgcctccctattctggaatatgactacacttagcctgtatcaaaaatgaattggagggtcccggaatggcggctcacacctgtaatcccagcactttgggaagctgaggcgggtggatcacctgaggtcgtcaggagttcaagatcagcctggccaacatggtgaaaccccatctctactaaaaatacaaaaattgcccaggcgtcgtggcacatgcccatagtcccagctactcggaaggctgaagaaggagaatcgcttgaactcaggaggcagaggttgcaatgagccaagatcacaccattgcacaccagcctgggcgacagaccaaggctctatctccaacaacaacaacaacaacaacaaaaatgaattggaggctgggtgtggtagatcacacctgtaatcctagcacttggggaggttgaggttaggagtgcgagaccagcctggccgacacagtgaaacaacgtctccagtaaaaatacaaaaaatagctgggcgtggtggtgagcccctgtaatcccagctacttgggaggctgaggcaggagaatcgcttgaacctgggaggtgtaggttgcagtgagccaagactgtgccattgcactccagtctgggcaacgagagcgaaactccacctcaaaattttaaaaattaaaaaaaaaaaaaaaaaaaaaaaaaagaattggagtctcctcagaaacaagagaaaggccattaactagtaagcaagaaacattaaccctagcctttaaaatgaggtttctctggttaaagaacttctgcttcaaaatattttcttccctaaatcaaaagcataaaatataccttacaaactttatcacatccaaataaaaactatttgcaaaagacagttatcttgtacaccactgccttctcaaaacgttgtattcaacagatattccctacttaagggcccaaactgtcttcctgcttcctgtacaaagcatgccaaaaatcattttattattcaaattttcccataaccggttcctaagaacttttttaaagatcaatttccaactactttccccaaatatttgttagtgttataccaatctcatcatctcctagacaaatgtttcaatgaatgtgaagctgttgctgctgctggaggtaagggttattagtcagtagaaggttaaaaaaaactgaattaaaggttaacacatgagctgttcatctttatttatactcatttttatattttatcagtccaaattgccgttcgtccttccaaagagattttcaacaagtcccacctccttccaagaaaatgtcccgggttaatgagttcctacttgctttatccacactgccagacctcctaaagcacggtgattgtatcttactttctgtgtatttaaatctcatttccagagcattcataatcttatgccacattatttatttcacttattattgcctcagtttcttgtttgttgagacagggtcaagctctgtcacctgtgctggagtgcagtggtgtggtcacgaatcactgtaacctccccctcccgggctcaagtgatcctcccacctcaaccccataaatagctgggataacaggtgcatgccaccacatccagctaatttttgtatttttttggtagagatggggtttcaccaagttgctcaggctggtctcgaactcttggactcaagtaatgcacttgcctcaaactcccaaagtgctgggataacaggtgcaagccaccacacccagctaattgttctattttttggtagagatggactttcaccatgttgccaaggctcgtctcaaactcctagactcaagcaatccacctgcctcggcctctcaaagtgctgggattacatgtgcaagccgctgcacccagcctttaattgttaactaatgttagtttattgaagatgtggacaaaatacaaatatatttaaatgacccatgtcccttagcagagtcatacaccaagaaaataaatgcatagcaaatatttgttgagttgtataatttttttcctaacaggaaaatattaactttataataattatagccagaagataaataaatctaacaattagatataaaattactccttcaatttttctttttcagttatatgaaagtaaggacgcagtcagtattttccaaagggaagaatttttccttaaactacagaataatttctaaatacaaccctcagatagattatgaagacatctcctaagagagtataataaaacttggtagggaccatctattcatcgacataattttatagacccacagaggatgtaggtcaaagcttatgtctctacaggccaatacatggcagaactggggcaaaagtctgcatctaactaatatttcattcctcttttgttcagttaattcaatcatttatccgctcatcagcatttgttaggtactaaggatacaagaaaaaatgagagacctatccctctcccctaacccatccttcaaagtgcttattacgttctaatactgcggcaaagaaaaacaatgtaaataggtaaatgttatgtactacattagaaggtattaaatgctagagagaacaaaatataggatagtgaggggattaagaagtggaaatggtggggttggtcgtgacggctcatgcctgtaattccagcactttgggaagccaatggaggaggactgcttgaggccaggagttcaggaccagcctgggcgacgtggcaaaaccctgtctccacaaaaacaataataataaaaattagcctggtgtaatatcacacctgtagttccagatattcaggaggatcacttaagcccaggagagagagagagatacaagtgggagggggtactacaggcgcataccaccacgcctggctagttttttgtatttttagtagagaaggggtttcaccatgttgccaaggctggttgcaaactcttggggccaagagatctacccgccctggcctcccaaagtgccgggttgcaggcatgagccactgtgcccctgcttgaatgtttatttgaagacagaatcaaccagctatgccaatgtgcttacaagataggagggaaaagagtcagagacactgccaaggtttctagcttccacaaccagaagaatggaactcttcttcatttgttcagaggacatttgaatacacattagttttaattaaacctatttttgaaaatatgtgctcaagtgttacactgaagcaaccaacaatcatccatacactgtccattgcccccaagatatgtaagttcactatggcattcaaaaccaaacactggatcctctaatttaatactgtacctcacaccaaaaaggatgaaaacagctaaaaagaggctgagcaaataaaaagcatccaagtaggtaagagtcattcatgcaggtagcatctattgagtggctaccacgtgcaaggtagtgtgaaaacacagtaataaaataaaaacagattctaccataaggagcttatgttcatctagccttgaacagacaaagagacaaagtattatgacagtactataacagaagttgagagaaggtgatgtcagagcagaaaagagcctaactgaagagactgatgaaagtgaggctttacagaggaggtctacataattacttaacattccccaaaatatatttaatatattttgagctatacttattcattaactatacacttaatgactttgcccttttctgtatacaatgtttcatatgccacaataacacttatttcggataaagtttactcatgtttaataaccatgaaaagaaaggttagcattagctgagaaaacttcataatgttctactccacacctgtcatgctaccccaacatgggcttccctaacattccaggtttaaactgggtcagtgttgaatagctgtgccattagcctggtggcaataaacttagggctgctgtactatgaaatagcaaccggtagaagccgaagaaaaaggtcaagagtctccttttccttcgccatgtcccgagtcagagccaggatcatgcttaggctgcacaggcctagaaaactccaagagtgaagcaagcttctgctttacacaaggaccaaaggaactggaatgggtcacagttacatgcagccttaatacctcctaagtgactcctctgtggatgaaccctctctcaactgtatttgcaatacagctaacaggcaatttcacatacttccttacatcactctatcaggtcaatcttccctatgcatctcaagacaaaccagtgaccccactgcagaccagttccacaagaatcaccctgggctacctggaaaagataagttgtctaaagtgctttaaaaaaccctattaagatgagaacttcaacagctttatgaaaattttgaagagaaaggtgttataagcttctgcagttcccattcaactccttccctattcaaaagtttcaatgctcttccacctcccatcctcaataacatttccatcctcagctacagctgtgtaatctcaaagagtagtcagaagaggagattttaaaaaacaacgtaagagtcaagccagtgcttctgggaggccaaggcaaggaggatcacttgaggtcaagagtttgagaccagcctggacaacacagcgagaccccatcctttaaaataaaaaaaaccctttaacaattagctaagcatggtgggacttgcctatggtcccagctacttgtacttgcaaggctaaggtaggaggatagcttgagcccaggagtttcaggttacaaagaactatgatctggccattgcacctcagcctgggcaacagagcaagaccctgcctcttaaaaactgcttagtccctattctttcccctcatttaccaggtgtgaaatttcaacaaacatgtttcagtgaaatgatgaaaaggacacaacagcaaagtatgttagaaaaaaaatgctttggaatcagataaaaagtcctgagtttaaatttagctctgccttttacaagcctctgaagatttattctgatcattaaacgaacatacatgagtaaacctttaattagtatacactcaaggtacgtatattgttttcgtttctccttctaaagcatggaagagtttctttttaaaaaacaagctgacaaactatgaaaattaaaagagtacaacagcatgcagaagtagtacagaggagttcctagaagttatattctttctccagagagcaatattattcccaaaagggactctactcacttcacagcttggaaggtaatacctaccttctgacagaacagaaactggtgtctggatcctagaatcacctagcagtagtcacaaatactttttttttttttggtaatacgccacttaaataaaattaatgttaataagcaacaaagtaaatccttaaaaagaaaagccccaccatccctccaatctcccacccgaagacaaattataactcaacagcctatcaccaagattcagcctatcacctaggttcatctcaaaaaaaaaaaaaagacctgtgcaacccaggaagtgctgggaaatcttggtgcagcatggaaaatatgaacaccaacccacttaaccaaaacacataggaaaaactttcttccatttcagtaactaaaaaaaaaacccaagcacttaaagtgattactaacttgagcaatagctctgcactcacttggatgtgtaaccatgaacaaactacttgactgctctgatcttccattgtttatcttgaaaatcgtgaatgagagtaaaatgcttagcacagtgcctgacatatcacaagtgctcaaaaacttctattaattatagtgttacataaagactaaatgcatgtgaatatatcattgggggaaaattccatggcttgttagagcaagttgaatattgtctcttccaaatttatgttcacccagaacctgtgactatgaccttgtttagaaaaagggtctttgcagatgtaatcaagttatgaagagccatttagtgtgggctctaaattcaatatgactggtgtcctcctgacatggaaatctacacagatgcaaagagaaagatggtcatatgaagatggaggcagcaactgcagtgatgtagctacaggccaagaacaccaaggactagcacaatatcagaagctggaaaaagacaaggaaggattcttccctagagcctccatagagaccatggcccttttgacaccataatttcagacttctggcctccagaacggtgagagaacacatttctgattttttaagccatcccatttgtgatagtttgttatgacagtctaggaaactaatccatttgttgaaaaagaaatgtataaatacgacacgtaaagctgtgaattttcttgatgcattacttattggaactatcaacctagttttattcttcctatcggaactctgagaagtaaaagattatctatgatgttgtattttacagaccaagaatctgaagctcagaaatgttaagtgacttttcttctcaaggttcatgtaagcagctggtagcaaagccacgattagaaacaaaaatttaccaagtccaagtatggtgcttaatacaatacgctttgaatgatgaaactcttggataagcaacatacattcatgtgccaaatagcattatggtcaatgacagaccacatatacaatgatggtcttataagattttaatacagctgaagaatacctgttttagcacaaagcactactcctgtgtttgtggtgatgctggtgtaaagaaacctacagtgctgctattagaagtataccacatacaattatgtacactaagaatataatagctgataataaaagctatgttactgttacacttatttcttatgataataaaaagtgttatgtatttactatactatacttttaatcgttattttagagagtacttctactcattaaaagaagtgaactgtgaaacagcctccagcaggtccttctgttggcactgtcacaggcaatgaaagctccgtgtgtgttgttggccctgaaaacctaacagtgtaacaagatgtgaaggtggaagacagtaataccgacaaacctgaccccatgtgggcctacgttcatgtgtgtgtttgtgtcttagtttttagcaaaacagtttaaaaaataaaactttcattttaaaatggaaagttttaaagatagaaaaaagcttgtagaataaggtgtgaagaaaatatttttgtacaattacaatgtatttgtgttttaggctaagtgttattacaaaagagtcaaaaagttttaaaaacttaaaagtttataaagcaaaaagttatagtaagctaaggttaatttattattgaaaaaaatatttaaaataaatgtagtgtagcctcggtgtacagtatttataaagtttatagtagtgtacagtcatgtcccaggcttttcaatttcagttacccttcacccaccgactcacccagagcaacttccagtcctgcaagctccattcatggtaagtgccctatacaggtgtaccatttttatcttttctactacatttttactgtattttttctatgtttaggtatgtttaaatacataaatctttaccactaattgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatatgagacagagactcgctctgctttgcccaggctggagtgcagtgtcgcgatctcagctcactgcaccctgtctcccaggttcaagtgattctcctgtctcagcctcccgagtagctgggattacaggcacccgccaccacacctggctaatttttttgtatttttcatagagacaggggtttcaccatgttggccaggctagtctcgaactcctcacctcaggtgacccacccaccttggactcccatgcctcggcctcccaaagtgctgagattacaggcgtgagccactgcgcacggccctcagcttgaatttaagtgcactttatgatgttcacgcaccaatgaaatcacctaacaacacatttctcagtttcccttttgttaagcaatgtgtgatggtatatacaaaactccagattattttccagatatttagaaatacttttcagatattttgatattttgaaagtttctgaaaattgctctgtcattacttctgagtgatgagctgaagaataaagcatgaaccaaatgaggtgagtatcttcttatacacagctagtgagactataaactgacactgccaaaatacttctctgaagaatgcattaagaacataaaagagcattcatacctttgactgagataaagatatttatcatggcatatttaatttaaataacaaatgtaacttaaatagtcaacaaagaaagccaatagcatgcagccattaaaaatgttttccaaaaaccaactgggaaatattcagggcacatacgtaacatgactgtatttgaacaaattacttatgtgctaggaaaatgtaccataatgttggtagcgagataattttgagctgttgggttgttttttttttttttggggggggggggagggtgggtgtcttttatacttctatgtcatttcagtttcctgagaattgatacacagtatttcatcaattctaagaggtactctccccacatgtcaacaacttttaaatcaagatgcattttacaatttctgttatgccctggtttaactgaaataatttctttgtcgtacttaaaacaatggtacatcttacaatcaatagcatcttaagttctatgaaatgtagcagttttataacaaggaactaagatgatataacatatacacatatataaacccacatatatatttatgaatgtatataaaaagatgaagcagcacttatgactactattatactaatctcagttgttactaagagactctagttctcaaatatagaaaatcccacttaactactggctataaaaacctagaaacagacactgaagaggtgtctctgatagagaaagactgtgtttttctcctcagtacaggcatatccagtcacctcctagttattcttagtcatcattccagttcaagttctacaaatctcactttaaaatttcctttgtgaagacttgggaaagcaaaatatgcaccaaatctagaatgtttattagttttgttccagctaatttttaaataagtaaatcaggatttaatttgtatgctaccctaagggaacaaactagtaagaataaaaaagtgagccctctggactgtgtcctcaattaaagtatgctctattgaacttttagggggagggggaatatatatatatatatgtatctccaatctggaaagaagctataagtccgcagtgacatttttagaataaaagtttaaatgattagatagcccacagaactttcacttcaaaccctgatcattctgttcattttatcagttgatcaaccttcaacttttggcctactaatttaatggatactgttcacaggaaagccattttcttaaggctttgactagtactaaggtcaaaaaggcattttgacccttatttttagtagcaatagactttttctagacatgggtctacataaagatagagctcagccacaccaagctaatataaaaaatactttgcaagaatgtaagcttcatgaaggtaggatttttgagaacactgctgagacacagtaagcacttaaaataatggtacatcttaccatcagtagcatcttaagttctatgaaatgtggcagttttataacagggaactaacaaatataaatctaacaaatatgacagttaacatcaatggcttgcttgcattattcagtctgttttccttgtttcctgttagctcagatacccacacagttttgttctaaatacacgttcagttaaacattatattctaatagtgttttcctttttatgagacaggcctttcttagttgtccaggctggagtgtggtggcacaatcttggctcactgcaacctccacttcgtgggctcaagcgatactcccacttcagcctcctaagtagctgggactacaggcacatgctatcatgctcaactaatttttgtaatttttgtaaagacaaggtctcactatgttgcccaggctggtctcgaactcctgagctcaaatgatcctcctgccttggcctcccaaagtgctgggatcacaagagtgagccaccacgcgcagccacatcaggttcttaaattaaaccactatatcaggtcattaaaccatttactttgcaatagttaagaagagggttatgggggttacgaggtgggaggggatgtgagaaaagcgatattgatagttttcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaagacaggtggtaaacgattcttcactccaactagaaaggaaaaaatgacaacatactatgaaaaaagctatgaggcaggaaaaagcacacgtcaaggcatggagatacggatatagactaggtaattttgcaaccacataagtgaaagaaaatttgctatccaatcttcctattctctactcccaagagcctagtgcttttgtatagttttcagctcagtaaagtgcctccagatttataaaagctcaatgacaataacaaggtatctttattacaaaatagttgttaaaagtttgattcgaaaaattttaaggaaacctttcaggtaactgaaagtggagggtaggggcgcgactcatgaaggagttttttaaccaaagaaatgatatgatacatttttaaatgaccacttcagttgcaatataaaataacagattttggaggaaaatgtcaatacaaggatatcaattatcaattattaggttactatattggttcaaggagagatgatggtggctgtggagatgagtgaaatcaacagatccaagatatattttagagagtattgtagaagactaggaatgggagtgaccagacaggaatgaagacttctagacttactgcacactgtcatgaggaaggatggggatggaagggtacagtggaataagctgggttttagcagaaggaatcaagagccccattacaaacacattaaatggcctggcgtggtggctcacgcctgtactcccagcactttgggaggctgaggcaggcggatcacctgaggtcaggagtttgagaccagcctgaccaacattgagaaaccttgtctctactaaaaatacaaaactagctgagcgtggtggcaggtgcctgtaatcccagctactggggaggctgaggtgggagaatcgcttggaccctggaggtggaagttgcagtgagctgaggtcgcgccactgcactacagcctgggcaacaagaacaaaactccatctcaaaaaataaaaaataaataaaaataaacacattaaacgtttataatgtatttacaagactaacaatcagataaagtctgaacttcagaaaggagatagagctgacctgaaaatataaattacgaactattgttatatgaatgttacttaaaagacgaggaggccaggtgtggtggctcatgcctgtaatcccagcactttgggaggccgaggcaggtggatcacttgaggtcaggagttcaagaccagcctggccaacatggcgaaaccccacctctaccaaaaaaaaaatacaaaaattaatcgagcacggtggcatgcacctgtcagcccagctactcaggaggctgaggcaggagaatcacttcaatctggaaggcggaagctgcagtgagctaaggtggtgccactgcactccagcctgggcaacagagtgagactcggtctccaaaaaaaaaagggcagaagatggggcggaagaatagagataggaaagaggaggatgttgagaactaaaccctgaggtacttttagtattcaaagtgtaggggggtctggaaatcttgtagagaccagtaggggttggagtatgacatcttccaataatgaattctcgttgctgtccccttatgggtctgggtctacctgatagtctcttctggaagtcggtatcacttgtgcttaatttctactcttttgtgccctctatacagcctctactacaaatcttttttgaagaagcacagggagaaataacttggggaaaaaaaaaagcctatcttttagaaatagattctgaaatatttacagatgaaataatatgttgtacagaattggcttcaaaatagtccaagtaaggggtggtctagataaaaaaaaaaagaacagctctgagtagatgcctgttacagttgggcaatgcacacatgggaaggttcactgcactggtctctctgaatatttcacaataaaacataaaacatagtatggaaggttggcaaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcgtagcccgggcggattcagccccacaaaatgggcgcagtttgcaaacagccccccggcctgggcgccgagggccagcggcgggcgggggcgcgcgacggcggctccggcccgggcccgccgctctcctccccccgacgcccggagccgccctgactttccgggcgggggggcgaggcagagggggaggggaaggcggcggcggggagcggctgctttttcttctctttcgggccctttcccggccttgctccgcaccgacggggcccgagcacggctggagaccgcagcccggccgggagggcgggcgggcgggggcagagagtgaaaccgcccccccgccccgcacaaacaagcaccgccgtctgcagcccgaacccgcacccaggccgccacccccggccgcctctttccagccggggagcgcgcttcagccgccccccgcgccgccgcggcgagacgagtcggcttcgctacggtgctcggttctcccgccggctcggcgagcggtggcggcggtggcggcggcactgggaaaatggcggccgagctccttttccctccccccctttaatctgaagcggagggagaatggagcgagcgagcaagcgggcgagcgccggggacacggggaggagggacagcagcgcctccgccggctgcggctgcggcggcgaagggccgctccaccccggcgcgccgccagggggcgcccgccgcgccgcccccgcgggccgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggtgagtctaacctgaggcactgacgccgtcacatgccctccgtgctggggccggcggtgcggctcgccagttgaggggcagggcgggccggcgccgcggagcgagaggacgtgagcgaggaactgtttgcactgtgtagtaaagagggtaaggccgtcggcaccacactattccaaggctaaccctgcagaaagctccctgaccagtgaagcggcttccgccgcccgccctttgtccctagcagccagcctccgtatactgcagcacggctgggcactagccccagcaccgcgctccgcagccaccagagttgggcggggtggggagggtgcacgtagtcactgcgcaggccccagccagggcccgcgccgggccagcccgggaagggacagccgggagccagaggggaagtgatggccccgccggcgccgggcccgctgggaactgtagttttcgtgaagaaacacgcgtcttgttttgggtgtcatggcttggcagatccgccaaaacaggcaaatggcattacacaatgagtatttatgcttcctgccgccaccaaaaggaagttcactgccatgctaaaagtttaacaaagaactccataaagaaacacaagtctcacaacaaaaagccaacttcccacctcgttaccagagttggtttaaagtggtggcaccttatcatttctcatgaccagtttatcagtacagaactttatattgtccccaaaataggacctttaaaataatggaacctttcctagacttaaagaattcataaacataatgtaatacaaagtgtcacacaaagtgtaattctaccaccctttaaagttgccaaaagatgagtggagtatcttgagatttaaaagactaatctaggattcatcaaaactggcttaaatgactgaagaaaaaatcgttcaaatcattaaatcatcaaattcggcagataagaagggtatgtatgctctactaccaaaaaggaagacgcaaaatgcttcacacttttttgtggcttaccagaaccaatatccggcattatacgtcacttctgcttatcaaaaaacaccctcacagtcgttacagaacggttttagtcttcccacaaagttacactaactcacctgcccctgcaacatctgcacctaggtttctgcgaatttccatttgtactcctaaaatcacactctcaagcatagtcatagttctcaaataccaaaggcaggcagtttggagtcatagggtcaaattacacaaagaataaactaatatttgtatacacatccaaaagaggtctttagtcttggatttttaatttacaaccctggggaaaaactttgacttttttattgtacacacatacacacataaatagtaattccacaaaatacagtagaagggtattggaccaacagatggcgaactagagccccaatctgaggctcctgaaatctaaattagcagaatgaaaaataccaaataaggcaaagccctttgcagcgtatacttaaatattaaattcagacacaccataacaaaataatcttactgctgctccaaatttttaagactgaactgtcagatttaattaggcaaccaaataagcaagattatatgaaatatatttttctaatggattaggagaaaactggaaaatgctcatttttaaaaccatgtatttgggggaactataaattccagtttcccctttctctcattgcttagtgcaagagtcaagagttcacagggtttatggcacttaaatcagtcaacctgttgtatattcttatctaaaatcagacatctttcttattaggcatccacttgtacttttatttttttgacagggtcctgctcggttgcccaggctagagtgcagtggtgcaatcaaactcactgcagcctcccaggctcaggcgatcctacctcagcctcttgagtagctggcactacaggcatatgccaccatgcccagctgttatttttttcactcctttttgttttggtagatacagagtctccctatgttgcccaggctggtctcgaactcctggactcgagtgctggcattacaggcatgagccaccacacaaaaatcttatgaagagaaacaaattttcttaaatttccccccaaaaaatagtggatgtccaaaaggctgattgaaaacacctacatacaaaataaaacaaacaaacaaaaaaagatttaaagaaaaaggcctggtgcagcagctcactcctgtaatcccagcactttgggagggtgaggtgggaggatcacttgagctccggagttagagaccagcctgggcaacagagtgagaccctatctctacaaacaaaattttaaattagccaagtgtggtagcatgtgcttacagtcccagctactccagaagctgaggggattgcttgagcctgggaggtcaaggctgcagtgagtcatgatcatgccattgtagtccaacctgggcaacagagcgagaccatctcaaaatgaaaagtgataaaaaaataaaaacaccaacatatttcaaatcactcttggaatagtcatgttgactctccaatatccactctattctgattagttttaacccattctctttgccaatgattggttaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagcctgaagatgccaccaacatcaaagggaatagagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaatgattgagttctaatgttttttagtatttgtatcttactttatgattacagtattttatataactaatcttattatttcttcctcagaaaagacattccatggccaggcatggtggctcacacctataatcccagcactttgagaggccaatgtgagagtattgcttgagcccaggagtttgagaacagcccagggaaaacagcaaaacttcatctcttcaaaaaataaataataaaaaaatttagccgggggtggtggcatacacctgtagtccaagctactcagaggctcaggcaggaggatcacttgagcccaggaggtcaaggctgcagtgaaccatgatcacgccactgcaaaccagcctgggcaacagagcaacaccccgtctccaaaaaaagaaaaagaaaggaagggaggaaggaaagaaagaaaaaaggaaaaggtgttccctcttacacacagctctgtatccatccatctttgtctgtgttctctctacctagaaaaagaggaccatccctcattaccaccattccttgttaattcctctctccaatccacctacaactcatgttatcctcttatattccaccacaccactgttatcgtctactcacttcacttgacaataatgtaggctgggcgtggtggctcatgcctgtaatcccagcactctggaaggccaaggcaggcagatcacctgaggccaggaattcgagaccagcctggccaacatggtgaaaccccgcctctactaaaaatacaaaaagtagccaagcatggtggtgcacgcctgtagttccagctactcgggaggctgaggcatgagaatcacttgagcccggaaggcagaggttgcagtgagccaagatcacaccactgcactccagcctacgcgacagaaggagactgtgtctcaaaaaaagaaccaataatgtacagagttggcactacattacccttggttaaatgctgtctgtaattcctctgagtttgttttcatataccagtcttgccacctcaagccagcctgaaagcccttgcaggcaggaactgtggttgttctaatttaagatctgtaactcatctatagataataaacgtattccaaaaaggcactctctaccttccctgccacagaccttctaaacaagccagaaattcctaaacagaataatctcacaaattcagtacctcgtatgtccaaactaatctcaaaaggacaatgaataactttttttgcacttaagaaaaagcaattattatatattaactcaggacaagttctaaagcctaggccatttagtttcaaaagcacaggggcccatttttttggttacttacctaggacctagcccagggcctggcacaaaagagacacatcataagaactgactgaataaatgaaaaaggtagagtgtagtacttaagcacacaggacctaggtagcccgattctaatcctgcctccctcacttattctttgtgttactttgggcaaagtacgtattctgctctgtaaaatggagatagtaataccacctacctcttaagtttaactattattattagtgaatgaagctattttccacagttctaaactttaaaggttaaaatctgagtgaagcaaaaatcagcacctctttcctaattcaaacttcaaacacctatctacttaggacttggacctactttaattaaaaaaaaaaaaaaaaaaaaaaaaaaagcctggatgtggtgactcacacctgtaattctagcactttgggagaccgaagcaagtggatcacctgaggcctggagtctgagaccagcctgggcaacatggtgaaaccctgtctcaactaaaaatacaaaaattagcctggcattgtggcacatgcctatagtcctagctacttgggaggctgaggcaggagaatcgcttgaacccacaaggtggaggatgcagtgagccaagatcgcaccactgcactccaacctgagtgacagagcgggactctgtttcaaaaacaaaatccctgtctagactctagcaaacaatgttttcattcatgaacttagataacactatatataaaaatacttttagctccctaaaaacatattctgagaatgattatttacaatcataaatctaatgccacattaaatacttcaaatacatttaattcaacaaaaatctagtgagtacctattaagctcaagaatttattctagatatcacagaaatgaacacataaacctatgtaaaaacccatattaaaattataaaagaaacatctttaagctgaaactgaggcatgttctcacattaatatttaaccagctaaatattaaatagccagagtcaactaaaccaaagttaagaaatttaagtcaaaaaatttaggatgtagaaggaatatgttcagccgccacattttattagtgtgaaaatgaggccaacagaaagaagccagttaagagattgccaaagcgtcaaagctggaatcagggtctctcagtcttcaattctcacttttcccacttctaattcaccagtgctactcaattggtgaactggatgtgcaaacatgctaaaggcattaaacctaaaccatactacctatttcacagtgtcacaagtataaagatttagccaaatgcaagtagaagaaaatcctcatactgattacaatgactacaaagctcagaaatcaagattttttttcattaaatggaggccttagctgattcaaaatatcatacagtatttttatgtactgactgaatccagtagaaacaaactttcagtaagattaaacaaaagcatttcataaatggcaaagtattacaagaatgcatagcattccttcatttcaatccaacctaacaagatattttcctcctcatactactgatacaaactgcaggatttacataaagatattattttgccatctcaccacagaactgacccaataattcatacaaaagaaaaactaattattaggcagcctcctaatttaactgtgttagtaatgagaacaatactgttgtaggttaaacctaaatgtactagtaagtctagaaataatttactttaggataattcagaagacaacattaaagctcagctgaatacaattatatcactgaaagaaacaagtcaggttctctcaggccatcagctattgttaaaatctaacacccaagattgttggtcttctccacagtggtggatttaatagcagctaccagcactcatttctagtgcaagcagtttaagcaggattttatacgaacattttaataaagttcctcaatgagtttacacacacacacacacacacacacacaccctgattattttggtgaattttagttaattctaatgtttttaactttagaatattttaaaattctcaaataactagaatgtgtgaacgttcaatgaccaaacatagaaggagtattctaatatactgattttgcagattaagcaatctacgcaggacccaaactttttatcagataataaagctgagtgtcagaatttggccaaaatgtaccaagaaactacctgagttcttttccaaaggaaacataaaggtaaatatgcagaacttcaaggcagctgtgagcagccaagttgtggagggcctgacaaaagtgagtcagaagggaaaatgttcaaagagaaaaggaggcagcaggtgtacaaggcaaaacacaccttaaaaaatatctttacaggctgggtgcggtagctcatgcctgtaatcccagcactttgggaggccaaggtgggcagatcacgagatccggagatcgagaccatcctggccaacgtggtgaaactccgtctctactaaaaatacaaaaaattagctgggcatggtggggggcacccgtagtcccagctactcgggaggctgaggcagcagaatggcatgaacctgggaggcggagcttgcagcgagcggagatcacgccagtgcactccagcctgggcgacagagcgaaactctgtctcaaaatatatatatatatatatttttctttttacgtcagttgctgattctaagttatgatgcaacttgtaaaatcttgttctgatggcatggcaaacctagggactttggaagatggcagacctgtttcctccaatgaagcagcataccattcttggaaagggaattactttttttttttttgagacacagtctcactctgctgcccaggctgccaggctggagtgcatggcaaaatctgggctcaccgcaacctccacctcctgggttcaagcgattctcctacctcagctgcccaagtaggtgggactacaggcgcgtaccaccatgcccggctaatctttgtatttttagtagagacggagtttcgccatgttggtcaggctggtctcaaaatcctgacctcaggtgatccgcccatctcagcctcccaaagtactgggattacaggcgtgagccaccacgcccagcctagaacattatttttaacccactaattcttggattcttgaacttgtttctatgtacactcaggaacatacagctacaaacggggagtaaccaaagccactgaatatatgcaggagcaacttttttggagtatcaatttaatcaaggattatagtaaaatcagatatacttttgttaaaataaacacaaatatattacaggttgaccatccctaatctgaaaattcaaaaccctccaaaatctgaaactttttgagtgccaacatgacacctcaaatggaaaattccacacgtgacacctttgcttctgatggttctctgaaccatcagaaacactgtttatttcaagaacaaaattattttaaattttgtataaaactggtcggttgtggtagctcatgcctgtaatcctaacactttgggagaccaagatgggaggatcatttgagccctggagttcaaaaccagcctgggcaacatagtgagaccctatctctgaaaaaaaaaaaaaaattaagtccaggtacagtggctcaggcctgtaatcccaacactggaaagccatggcaggtgaatcacttgagctctggagttcaagaccggcctgggcaatgtagcaaaacctatctctaccaaaaacacaaaaaattagccaggcatggtggcatgcacctgtagtcccagctacacaggaagccaaggtgggagaatcacttgagcctggaaggtggaggctacagtgagcagagatggcgctactgcactccaacctgagtaacagaatcagaccccatctcaaacaaacaaaaaaattagctgggcttggcaccgtgcatctgtaccagttagtaccagctacctgggaggctgaggcaggagaatgacttgagcccaggagttctaggctgctgtgagctaggatcacattactgcactccagcctgggcaacagtatgagacatcatctcttaaagaaaaaggtaaaaaaaagaaattatcttcaggctatgtgcataatgtgtacatgaaacatagaatttcatgtttagatttggatcccatctccaagatagtacattatgtacatgcaaacatcccaaaatctgaaaaatctgaaatccaaaaaacttctggtcccaagcatttcggataagggatattcaatgtatacagagcaaaaggcagaattctcactgtttcaagatagaaaaggagtcctcagagagatatgtcctgcttgtaacaaacagctccaaacagccctagaccctgaaaagtactttaaggaaagataaagaggtactggtttagaccatttatagataaatatgcatggctaaaacccctgaatgtaatccttccaggcagaagataaaacctgaaatctaacgtataaattgtcatgggtacaatattataaaagagaccataagttaccgagaacatgactggaattcaggaaatgctaaaggtcctgtcttatctctgtaactcatttacaaagaaatcatgtatgattttctcaactgcaatcttttttgtttctgaattagactgacaaaaattatagaatataatattcaatattttccaccatattccaaattctcactatcacatttaaacacaattttatctaatgaaatgtgtcccaaatgaaccaactttaaccagcatcagaaaaaataaaataaaatagttaaatgaaactgtatcttctttggtataagaagtccttcaggccagacgtggtggctcacatctctaatactagcactttgggaggccgaggccagtggtttgctagaactcaggagttcgagaccagcctgggcaacatggtgaaaacccgtctctactaaaatacaaaaaattagccaggcgtggtggcatgcgcctgtagtcccagctactcgggaggctgaagcaggagaattgcttgaacccagcgggaggtagaggttgcagtgtcagtgagctgagatcgcgccactgcactccagcctgaacgacagagcagactccgtctcaaaaaaaaagaaagaaatccttcagcacagagggtaggaaaaaacaactactcacacttcccagaatacctaccgtggcaataccaaaatatgaccatgcttgttaatatttgggctacggcattaaatgtttataacataacacaaacacttgtaatccaaatgtgaatgattatcttcaattttcagtaaaataagaccctataaaagccctaccattaatacatattcattcataaacatactgagtaccagtggatgttaaacactgtagaatctctaaggaaagaatactcggtcactttataagctatgtggtagtcaagaaaaatcctttctactcattgatacgttaaatgatcaaaaaatccaaagctaaaaaatgatcagagaacaatgaaaaaattttagtggctttatgcttccaattccattttcttctggactcttttctgaagcttgcctaaatcatcccaggaatgctaaaattgggtgttatttatggcataaccaaaatgaaataacaaagtaagtaccccaaataaaactaggagaaaaaatccagggaaccaagcaggcagtaaggatctaaagttctatacttggaacctctaccctgaatgttaaataatagatgttttttaaatagttgactaccaagtgtggtggcatgtgcctgtaatcctagctacttgggaggctgaggtggagagactacttgagcctaggagttctagactagtctggacaaatagcaagaccctgtctcacgggtaggggagcaggggaaggcaaccaagctgggtgtgccatgtgcctctagtcccagctacttgggaggctgagacaggaggagtgcttgaaaccataggccactgtactccagcctaggcaacataggaagaccctatctctaaaacaaacataaacaaaaaggccgggtgtggtggctcacacctgtaatcccagcacttgaggaggctgagttgggaggatcacttgaggtcaggagttcgagaccagcctggccaacatgataaaatttttgtatctttagtctctactaaaaacaaaaattagctgagtgtggtggcaggggcctgtaatcctagctacttgggaggctgaggcataagaatcatttgaacctgggaagtggaggttgcagtgagcggagatcacaccactgcactccagcctgggtaacagagcaagactctatctcaaaaaaacaaacagttatatctttaattattatcttcattcagtaattaggcaattagaatttacaattgctaaatgaatgttcaaagttcaaccaaaattagtccaagatgaagccaagaacacatctcaactcattcaataaagccattattactctgatgccaaaaccagacatagatatcacaagacaactacagaccaatatatcttatgaatacagatgtaaaagtcctcaacaaagcaaaatgaatccagcaacatattaaaaggcttatacaccattgctaagtatgacttaatcccagggattcaaggttggcttaacttctgaaaatcaattaatgtaatacaccatattaataaaggatacaaaccacatgatcatttgaatagatgcagaaaaagcacttaacaaaatccaacatgctttcatgataaaaacactcaacaaagtagaaattgaagaaaacatcttcaatctaataaaaaatacctatgggggaaaaaaagaatacctacaaaaaccccatagctaaaatcatacttaatggagaaagcctgaatgctttctccctcaggtcaagaacaaaacaaggatatccactcttaccactctgtttaacactgcactgaaggttatggccagggcaaataggcaagaaaaagaaataaaaatcactcaggcttaaaaaaaagaaggaaaactacctttatttgcagatgatataatcttgtatatagaaaatcctaagaaaatcccacaaataaactattagagccaataaacacatccaacacagttacaggatacaagctcaatatacaagtagtaatcgtatttctatacacaagcaataagcaatctgaacatgaaaagtttttaaaaattccacttacaatagcatccccccgccaaaaaaaaaagacttagaaagccaagcacgatggctcacacctgtaatcccagcactttgggaggccgaggcaggcggatcacttgaggtcaggagttcaagactagcctagccaacgtggtgaaaccccgtctctactaaaatataaaaattagttgggtgtggtggcaggtgcctgtaatcccagctactcaggaggctgaggcagtggaatcacttgaacccaggaggcggaggttgcaatgagccgagatcacaccactgtactttagcctaggtgacagaatgagacactgtctcaaaaaaaaaaaaaaaaaagacttagaaataaatttaacaaaagcagtgacaatcttatactctgagatatataaaaattacaaaagaagttacagaaatcctaactaaatggaaaggccaggtgtgatggctcacacctgtaatcccagcactttggtagactgaagtgggtgggctgcttgagcgcagaagttcaggatcagactaggcaacatggcaagaactcatctctacaaaaatacaaaaatgagctagatgtggtggcatgcacctgtaatcctagctgcttggggggctgaggagggaagatcacttgagcctagtaggttacagctgcagtgagccatgattgcattactgtacttcactgcagcctggatgacagaacaagactgtgtcccccaaaaaaaaaaaaaaaaaaaaaaggaaagatatcccatgttcatggatgagaatggatcagaagatacaactctgttaaaatggcaatattccctaaattgatctacagaatcaatgtgatcccagcatacccaaaagaaatttgaataggaaaaacaaagttgggggactcacacttcctgatttgaaaacataattcaaagctatggaaatcaagacagtgtggtagtggcataaggataaacatacagatcaatggaatataagtgtgggttcagaaataaacctttacactgacagtcaattgattttatgacaaaaatgccaagacaattcagtggaggaaagaatggtctttttaagccaagtgctgtagctgacacctataatcccagcatttggggaggctgagacaggaggattgcttgaggccaggagtttgagactagccagggcaacaaagcaagacccccatctctacaagaaacaaacaatggtcttttcaacaaaccatgctgggacaactgaatattcacatgcagtagaatgaagctggaccactatatctcacaccatacacaaaaattaattctaattaaatttaaacacggattatagacctaaatgtaacagctaaaacaataaaattcctagaagaaaacaaagctaatcttcatttcatttggtggcctgacatcaaaaccacatgcaacaaaggaaaaaacaagtaaatttggcttcatcagaattataacattttgtacattaaaggacaccatcaagaaattgaaaacacaacccatagatgggagaaaatatttgcaaatcatgtatctcacaagggatttgtatctagtatatttaaagaactcttacaactcaacaataaaaagagaatccaattttaaaatgggcaaaggctgagcatggtggctcacaccagaaggagaggatcccttgaggcaaggattctgagacctgccagagcaatatagcaagaccctgtctctacaaaataaattaataataataaaaaaaaacaattagccaggcatggtggcacacacctgtagtcctagctactcaggagcttgaggcagaaggaacccttgagtccaggagtttgaagttccagaaactatgattgggccgggtgcggtggctcacgcctgtaatcctagcactttgggagtccaaggcgggtggatcatgaggtcaggagttcaagaccaacctggccaagatggtgaaaccccatctctactaaaaatacaaaaattagctgggcgtggtggtgggtgcctctaatcccagctacttgggaggctgaggcagagaatcacttgaacccaggaggcagagattgcagtgagccaagatagtgccactgaactccagcctgggtgacagagcaagactccatctccaaaaaaaaaaaaaaagaaaagaaaactgcgattggccactgcactctagccagagtgacagagcaagacctagcctaaaaaacaatagtgtataaaaataaaattaaaatgtgcagagaatttaaatagacatttctccaaagaagatatatgaatggccaataagcacatgaaaagatctcatcaggttgagcacaggggatcaggcctgtaatcccaacactttgggaggccaaggtgcggggactgcttgagctcaggagtttgagaccagcctgggcaacatggtaaaaccccatctctacaaaaaatacaaaaaggccaggtacagtggctcatgcctttaatcccagcactttgggaggctgaggcgggtggatcacctgatgtcaagagtttgagaccagcctggccaacatggtgaaaccccgtctctactaaaaagacaaaaattagccaggtgtgatggtaggcgcctgtaataccagctactggggaagctgaggcaggagaatcacttgaacctaggaggcggaggttacagtgagccaagatcacaccactgcactccaacctgggtgaaaggcaaaaatccgtctcaaaaaaaaaaaaagtttcaaagataaaacaaaaatcttgttaaagataaatacacgagatgctaaagaaataatctacttcttcaagtcatgctatcaatttgcaccaaaattttcatttcctatgtgtaggtgttgagggtcttgtacccatgataaatgacatacacctgttctgggctgacttttgttccccaaaagagatatatagtactccaaggggctgggcacagtggcacatgcctgtaatcccagcactttggaaggtcaaggccacagcatcgcttgagctcaggaattcaatatcagcctgggcaacatggcaagaccccggctctactaaaaatataaaaaaatagccaggtgtggcagtgcacacctgtagtcccagctacccgggaagctgagatgggaggattgcttgagcctggggtttagggggctggaggttgcagtgatccaagtgccactgcactctagcctggatgacagagggagaccctgtctcaaaaaaaaaaaaaaaaaaaaagatatgtagtactcctaacattcagcacctcagaacctgatcttagagacaggatcttcaggccaggtggcttcccttcctctccgcgtcagtctgtcccacctcagctcagcccaccggagacagagggtgcaggaacctggaggcggaggttgcaggaagccgagatcctgcaactgcactccagcctgggcgacacagcaagactccgtctcaaaaaaaaaaaaaaaaccttacaacaaaatgatgcagcccgggcgcagtggctcacgcctgtaatcccagcactttgggaggccgagtggggcggatcatttgaggtcaggagttcgagaccagcctggccaacatggtgaaatcctatctcaactaaaaaaaaaccaaaaactacagaaattagccaggcgtgatggcgcatgcctgcagtctcagctgcttgggaggctgaggcaggagaattgcttgaacccgggagtcggaggttgcagtgagccaagattgcgccgattgcactccagcctgagtgacaagagcaaaactccatctcaaaaaaaaaagaaaatgcaaagtcacctaagagacagtttaaatacataaaaagctcgatgccaaataaaactggatgggtcacttgataagtgggattgataaaaagcaagacagctgatattatataattcttatttgcttcgatatttactggggaaggtagaggggaaaagctatctaaattactcttaataagcatacaaatctctaatagtgaatcaaatgcatcattaaatatactaaattcctcaaactgatatgtcagatgtcaggtagtcatgaagacccaaaatagtctccatgggttttttgttgttgtttttttgagacagagtctcactctgttgcccaggctggagtgcagtggcaccatctcgactcactgcaacctctgtctcccgggttcaagccattctcccacctcagcctcccaagtagctgggattacaggcatgtgccaccacatttggctgatttttgtatttttagtagagacagggtttcactatgttacccaggctgttctcaaactcctgacctcaagtgattcacccaactcggcctcccaaagtgctgggatttcaggtgtgagccaccacgaccagccccttctctgtgttttaaaggcatttaagtataaattattaaactgcaggacagaacatattagctgacggtcatatgagtgaccttctctaaatgccaggaggatagaatccacttttcctttatcaatattttccttgctcaacttctgacatattaggtactcaataagtatgtgctgaaccaaaacgaacaaaaaaatgctgtcatcaaagtaacttccatctactcaagtaggctgcaacttcaaactgcccaaactagcaaatctctaataaagatgggctcagaagacatatcagcatgaataaccttctgaggaaaagacaacatggattctaaaagtggacatcacaccacaccagttcacccaaattctctgagaaaataaatatgtgtggctgggtgacggtggctcatgcctgtaatcccagcactttgggaggctgaggcgggtggatcatgaggtcaggagatcgagaccatcctagccaacatggtgaaaccccaactctactaaaaatacaaaaattagctgggtgtggtggtgagcacctgtagtcatagctactcgggaggctgaggcaggagaaacgcttgaacccgggaggcggaggttgtagtgagccgagatcgcaccactgcactccagcctgggcaacagagtgagactctgtctcaaaaaaaaaaaaaaaaaaaaaaaaaaaaaagacctgagtggccacaggatgagaacatttactgtagactggacataactgagacacagaaaattataggtagatgctgaggtacttccccaaatgaagaagtaaaaacagaagattgaaaatttttttagaaatgctatatttaacattttaatatattgtacaaaaaatatacagagaattccccattttgcagatgggatgatgagattcctaataatgaaataccacacgagttggaaaaataagggaacggagtgatggaaagggtttctaaatatattaaatgagaaacatttgcaaaaactaagatttatattcagcttagagaatgctttggcaagtataaaagctgtctaaatatgtgaagggttatctagcagaagacaaaccagacttgctctaagcagttcccgtgtagacaaaattgggcccaaagtggcaattccagaagggcacgcttcaactcaagctttctaaccatcagacctaactaaaaaggtggttcttaccttggattacctctaagagcccactgagatatgagtgttaaaaaattacatgcgaggaaatggcaggtatgttacagcatggacaaatgaaaagtaaggcatttacaggaaaaaaaatctaagctatacttaaaagactcatgccttcaagtcaaaaaaggaatttttgaataattatagaatattccctaaagacaatgtgatgttctatgcaaaaaaaaaaaaaaaaaaagggagggagggaggaccaaatcctattaggaaaaaactgtaaatcaagggtacccaatcgtttggcttccctgagccacactggaagaagagctgtcttgggccacacataaaatacactaaagtaacaatagctgatgagctaaaaaagaaaatcttaaaaaaaatctcataatgttttaagaaagtttacagatttgtgttgggccacattcaaagctgtcctgggccgcatgcagcctgtgggccatgggtcggacaagcttgctgtaaatagaacatattttcttatccttctaccaaatcacagtgtagttataactaaaatgcagttctgagtagttatcataaatccagaaagggaaagcaatgctgacaaagatcctggaaggaggtttcactggagattaaattaaaaagtcaagcatcttcagttgagaaacatgaaagcaaaggggcaatgtgatcaaaatcagaaaacgtatcaatatggtaaatactaatttattcaccttttatgcttgaaaagtatttctttatataacagataaaagaaacttgtggattgtgttaccacaatctacaagttaaaaatagattcaagtgctcggataaatgtaggtatattaggtccattcaggtcctacaggatagaagtgctatcagacgtgaggccctaaatttctgaggttaacatcttaacagataacaatgtttcacctgaaaacatcacttggtgccaatttagacagaacaattggttggacagaccccggacagacagactcaaggaggctggttggtatagacttccttccattcttttacctcagtatgtatgtgtgtgtaatatatacatacatattatactagaacatatatacattccttatctttatacacttagaatgctccttatatagctctgcaccctgaatttttcatttatcatttactcaacatcctaagacattaaaaattctttttttttttttagacagagacttgctctgtcaacaggctggagtgcagtggcaccatctcagctcactgcaacctccaactccctggtccaagcaattctcctgcctcagcctcctgagtagctgggatttcaggcacgtgccaccacgcccagctaatttttgtatttttagtagagatggggtttcaccatgttggccaggatggtctcgatctcctgacctcataatccgcccacctcggcctcctgaagtgctggaattacgggcatgagccaccgcacccggccagaaaaattctttcaaatactattccatggttgtaaatgtccatccttaaatataccatgatttattttcctataaatcttgctgctcatttaggtttattctcaattctcactaatatgaataatgttacaatgaacatctttgttcacaaatctttctatgtatcttaatttttcccctttaggataaattcctagatgtgcaattactgaattaaagaacgtttttaattttgccaatatatgttgccaaaatatctttcaaaaaaactaggcccaatgcacactccactagcagtttcagagattgtcccctcaccaccttcgacagcacagtcaactgtaaatctgataggttaaaaaaagagtatgtcatttaatctgcattcctttgattacttatcaggataaaaatgtttctcatatgcttcttggtcatttgtatttcttccttatgaactctgatcatgttctttgccagcaaaacttttctttctcttggccgacaaactttctgtggaaaaccagctgagatggaatcatttaaatatcagcaactgcagctccccctgctgacagataaattaccaccaccatcaagtgcccagtaaaaaaaagtgagctagaaccatacgcttgcctgtcttctgggctgctgctacaaatacaaattatacacggtaataaaaaagaaaatactgtgtatctaaactcatacttaacagagctgtgatggagaaggcaagggggacaagcgttttatttgttttttgttgttgttgttgttgttgttgttttttgagacggagtctcgctctgtggcccaggctggagagtagtggcgtgatctcagctcactgcaagctccgcctgctgggttcacaccattctcctgccacagcctcccgagtagctgggactacaggcacccaacaccacgcccggctaattttttttttttttttttttttagtagagacggggtttcaccatgttagccaggatggtcttgatctcctgacctcatgatgggcccgcctcggcctcccaaagtgctgggattacaggcgtgagccaccgtgcccggcccaaacgttttctaatgtgcaggaactaggcggggtgcagtggctcacacctgtaatcccagtactttgtggaggccgaggtgggtggatcacctgaggtcaggagttcaagaccagcctggccaacatggtgaaaccctgtctctactaaaaatataacaatcagccgggtgtggtggcacgtgcctgtagtccgagatactcaggaggctgaggaacgaggattgcttgaacccaggaggtggaggttgcagtgagccgagactgcgccactgcactccagcctgggcaacagagtgagactccatttaaaaaaaaaaaaactaatatgcaagaactaatgtcacaaacaattctaaaaatcaattccctgccaaatatactacctggcacatataaacatcacagacctaaatattcatttccctatactttaactatgtgaaaacactctaaattaccaaatgacactgggtggtcagcaaactagttctctttttccaaaagcaaaaacaacaaaaacacttttgccctttagcattcaaagaaagagtattaaaaatcttaattcttggcaatccttattccaaagttgcttgcacttatcagactgggaccaatagatccaaagagtaaggccaagactggcaaatgcatgtgactctcagcttttccactgataccctcctaaagatgcatgtcccaagtccagcaatacagtctttaacactcatttactaagtgccatcaagagcaagcagtgatggccgggtatggtggctcacgcctgtaatgccagcactttgggaggctgaggggggtggatcacctgaggtcaggagttcgcaaccagcctgaccaacatggtgacaccctgtctctactaaaaatacaaaaattagctgggcgtggtggcaggcacctgtaatcccagctatttgggaggctgaggcaggagaatcacttcaacctgggaggcagaggttgcagtgagccgagatcgcgccgttgcgctccagcctgggcaacaaagagcgaaattccgtctcaaaaaaaaaagaaacaaaaacagcaagcagtgaggataaaagacaagagcaagtcctcactctcaaagaacctagacactagctgggttcaaagtggagcaaactagcaatcagtacaatagaagtgctaggtctgcatatgcacactcacatgcacacacactaacagtttcagagattgtccccttaccacctttgacagcacagtcaactgcaaatctgataggtaaaaaatagtatgtcatttaatctgcattcctttgattatttatcagaataaaaatgtttctcatatgcttcttggtcatttgtatttctttatgaactctgatcataaagtgataatacctgggtccagaggaagcactcagtgtcagctactgttattactattatcactactgttattttgttttaaggctaatcaagtgaagcagtgggagtggagaaggaacaaagaaatctgtaactggctgtgatcaattaatagtaaacaccaatatacttggaccagccactactgttattaaagactagggggagtaagtttccagaacagggtagagtccatcttaagcagaggtaactgcttgtgtgaagacccagaggcaaagaacaacagggttcacagaaggaactgggcacaagctatctgtactactgcgtacaggatgctcaggaagaagtggagagatgatctggcaaaacatttcaactctaccttcaaagctagttgagccatggtggaagagggagggatatgatcatacgcttgaacatgcattttacaaggatcatgttggcagcgacttggaagagagaaagcagtcaaggagaatgattacaagacaacagaaggtcacgcagccaaaagggcgatgaaggtctggactcaaaaaggagaagtaggatgactaggaaaatattatgagctaggatctcaagaatgtggtgactagaatggcacaagaaggaacccagaggcctctcaaatccctgatttgagtgactggctgggtgacactaccgctcactaagatacgaagataggaagaggttggactggggaagtggataagatcattttaaaatgcccataagatggccagatgcagtggctcacgcctgtaatcccagcactttgggaggctgaggcaggtggatcacctgaggtcaggagttcaagcccagcctggccaacatggtgaaaccccatctctactaaaaatacaaaaactggccggacgtggtggcgcacacctgtaatcccagctacccggaggctgaggcaagagagtcgctggaacctgggaggcagaggctgccgtgagccgagaccgtgccactgcactccagcctgggggatagagcgagactccgtctcaatagtaataataataataaaaaaataaaataaaatgcccataggacatccaagtagagatgtccaggaagcaactgtgtatatgggattggagatcagaaaactagtcagagctggaaaaacacacatttgcaaatcatcggcatatagacggcaagtgaggcacaagtttatctaaggcattcctcataaactgcacagggtgagaggaagaagggtcaagggaaggcaaatactaatgtttttaggagcaaaagaggaaaaaagtctgcaaagaaaaccaagagtatgggccagacttggtgactcacacactttgggaggccgaggcaggtggatcacctgagatcaggagttcgagaccagcctggccaacatggtgaaacccatctctactaaaactacaaaaattagccagatgtggtggcgggcacctgtaatcccagctactggggaaactgaggcaggagaattgcttgaacccaggagacggaggttgcagtgagccgagatcacgccactgcactccagcctgggcaaaagagcaagactccgtctcaaaaaaaaaaaaaaaaaagtttcaaagataaaacaaaaatcttgttaaagataaatacatgagaagctaaataaataatctacttctttaagtcatgctatcaatttgcaccaaaattttcatttcctatgtgtaggtgtcgagggtctagtacccatgataaatgatatacacctgttctgggctgaattgtgttccccaaaagagatatgtagtactccaggggcctgggcacagtggcgcattcctgtaatcctagcactttgggaggccaaggccacaggatcgcttgagctcaggagttcaatatcagcctgggcaacatggcaagaccccatctctactaaaaatatttaaaaatagccagatgtggtagtgtgcacctgtagtcccagctactcaggaagctgaggtgggaggattacttgagtccaggggttagggggctggaggttgcagtgatccaagtgccactgcactccagcctgaatgacaaagggagaccctgtctcaaaaaaaaaaaaaaaaaaaaagagatatgtagtactcctaacattcagtacctcagaatgtgatcttagagacgggatcttcagaccaggtgcagtggctcacgcctgcaatctcagcactttaagaggccgaggtgggtggaccacttgaggtcaggagttcgagaccagcctggccaatgtggtgaaaccccatctctaccaaaaatgtaaaaattagctaggcacggtggcgagcacctgtaactccagctacttggaaggctaaggcagaagaatcacttgaacctaggaggaggaggttgcagtaagctgagatcaccccactgtactccagcctgggcaacaaagagagactctaaaaaaaaaaaaagagataggatcttcaaagaggtcataaagttaaaatgaggtcatcagagaggactctaatcccaatatgacttgtccttataaaaaaggggaaattgtggacacaaagaaatacacacagggaggctgggcgccgtggctcacgcctgtaatcccagcactttgggaggctgaggtgggcagatcacttaaggtcaggagtttgagaccagcctgggcaacaaggtgcagccctgtctctacaaaaaatacaaaatttaggctgggtgctgtggctcatgcctgtaatcccagcactttgggaggccaaggcaggcagatcacctgaggtcaggagttcaagaccggcctgggcaacatggtgaaaccctgtttctacaaaaaatacaaaaaattacctgggcatggtgacacgtgactgtaatcccagctacttaggaggctaaggaaggagaatcacctgaacctgagaggcagaggttgcagtgaaccgatattatgccactgcactccagcctgggcaacagagcaagactctgtctaaaaaaacaaaagaaatacacacagggagaactctacataaggactggagttatgctgccaccagaagctagaagagaggcttgaaacagatcctgtcccagttgcttcagagaaagcatgcctctgcccttagatttctagcctccagaacagggagacaataaatttctgttatttaagccactcagcatatgtcactctgtggcagcagccttagcaaacagatgtcataagaaaattcgcagctcaggtttactaagtacctaccaggtgctgttctaaacactctgcgtgaataaactcatttaatccttataaagtccactctaggatctaggtactatcattataccctttttacagtgtggacaccaaggttctaagaggttaatgagcttacccagtatcacatagccagagccctctctctcaccactagtgtatgaggagctattattaacagtaattacaataagagctggcgtggtggctcacgcctgtaatcccagcactttgggaggccaaggcgggtggatcacttgaggccaggagtttgagaccagcctggccaacatagtgaaaccccgtctctactaaaaatagaaaaataagccgggcatgctggcatgcgcctgtaatcccagctacttgagaggctgaggcaggagaattgcttgaactcaggagacacaggttgcagtgagccgagatcgtgccactgaactccagcctgggcgacacagcaagactccatctcaaaaaaaaaaaaaattagtaattacaataagaacagtagtagtccactgaaccaaacactgccctatgtcctttacagatataatacaaaagtcctctgaagtaagtgttattatttccagtatgaaggaggaacctgaatctcagagagattaagaaaatcgcccaaagtcacacggttaagagtgctgagattaggccgggcacggtggctcatgcctgtaatcccagcactttgggaggccgaggcgggtggatcacctgaggtcaggagtttaagaccagcctggccaagctggtgaaaccccatctctactaaaaataaaaaaaaaattagctggccatggtgacaggtgcctgtaatcccagctacttgggaggctgaggcaggagaatcacttgaacccaggaagtggaggttgcagtgagccaagatcacctggacaacaaagcgagactcttgtctcataaaaaaaaaaaaaggaagaagaatgctgagattatatctaattgctaacttaaggggatatacaatgaaaacctgtttttactaaaactttaagaacaagttaattttttttttttctttaatgagacaagagacaaggtctggctctatcacccaggctggactgcaggggcgcaatcacagttcactgcaacctccacctcccaggctcgagccatcctcccacctaggcctctcaagtagctgcaactacaggtgcacaccaccatgcctggctaattttcttttgtatttttagtagagatggggttttgccatgttgcccaggctgttctcaaactcgtgtgctccagcgatctgcctgttcagcctcctaaagtgctaggattacaggcgtgagccatcgcgtctggccaagttaaattttttaatgcctgactttgcagttcaatactagaaatatacatctataaattcaaaattcttgaagatcccaagagaacacatgtcctagattatgggcccttttgcgtgtgtatcccctcaaccactgttcaagaactattctctcggctgggcacggtggcccacgcctgtaatcccagcactttgggaggccgagttgggcggatcatgaggtcaggagatcgagaccatcctggctaacacggtgaaactccgtctctactaaaaatacaaaaaattagccgggcgtggtggcgggcgcctgtggtcccagctactcgggaggctgaggcaggagaatgacatgaacccaggaggcacagtttgcagtgagccgagattgcgccactgcactctagcctaggtgacagagtgaggctccgtctcaaaaaaacaaaaacaaaaacaaaaaaactattctctcagttagaacccttgccatttctctgacttccagacacagaaagagaagaaaaggaaggattgagatgctgttctttaaaatttttttttttttttgagacggagtctccctctgtcgcccagactggagtgcagtggcacgatctcggctcactgtaaactccgcctcccgggttcacgccattctcctgcctcagcctcccaagtagctgcaactacaggcgcctgccaccacgcccagctatttttttgtatttttagtagagacggggtttcaccgtgttagccaggatggtctcgatctcctgacctcatgatccgcccgcctcggcctcccaaagtgctgggattacaggcgtgagccactgcgcccagctaaaattttcaattttctatttaatttttaaaatctgatacaaacatcagaaagtgtaaaaagatataatgcaatgagaagtctccttcctactctgtcctctacctgaacaattcctagacctaacaggtaaccagtgccaccattttcttatttattcttctaaaggtttgtgttgttgctgttgtttgagacagagtctcgcttggtcagccaggctggaggacagcggcgtgatctcagctcactgcaagctccgtctcccgggctcaagcaattctcctgcctcagcctcccaagtagctgggattacaggtgtgtgccaccatgccccagctagtttttatattttcagtagagacggggtttcaccatattggccaggctggtctcagactcctgacctcaggtaatccacccaccttggactcccaaagtgctgggattacacgtgtgagccaccatgcccagccctaaagatcttttttttttttttttgcatacatacaccaatgcaaattatctttttctcctgtttttttttttccaaaaaacacaaagggtatcaaatcatacatactgttctgcatcttgctttcatcacttaactgtctgccttgcagatctttctatatcatattaaattatgttttaattctctcgttttgcttgtcaagaacagtttttacttcatttcaccatagttcagtctagcacacaaggcatccagcagccctaagaactacctgaaacaactgatgatggctccatgctacacactaaagaccctgtatcttttctctcctcctcatcttcatttcactcttttctccgactcactcaattctccttcctttccctattcctctcccatctcacccactccttagccctaaccctgacaactagaccctagtaacatcactgacattgcttagtcgtggctagaaatattcaggctttaaaaaggtacagacccctaacacagagaaaaagggataaataataatttccatgagaacttctaattaacgagagtgccttaaattgaggagttttggcttggagttattcttccttgttacttgcctcctctggcattttcatttgtgaagactgagtgagtgtgacgctattttctatacgcatggaaacaagcacatactcagtctaacatttacgcaatgcctgacagaacgacagagttcattctacaataagataattggaaacaaaatataagatctatataaaataaacatttgggctccaaaatatgcactttaattaacctatcatttctttttacttaaattaagtagctccaatctgaaactacatcttagaaatgttttaaggatattcaccaatgaaaaagagaataaagttccctctccccacttttattttccagcccacaaactcaatgctatcctccccgcaaaaaggacctttttttctgaccagacgaacactgtaatttttaaggtttctaagtaataaaaataggaagaaaacattaccccccaaaattggtttacacttagaagatgtttcccactgagcaaaggattggtaaggaacataatattaaggcaaccacctaactgcattcttaagtagtaacaggtggtaactcacgatatggagctgatttcctttctctattcctgccatgccagagacctctagtagaacttctgaggttactgtattacaacccaggttcagagagatttagaggtaaaaccttaaacactggaaatatctttaaaagtagggctttgtgtaccaaatacattcgttaaaacctaggaaactataaaatgaaatccaatgtattgatctcaatccccttgcctgcttcctaaagaggacagaggccaccaacactggtgctcaacacttgctaagtcgaaacactcttacacaggtcctctgattcttaacgggttcagaacttctggttgcattccccatgcaacccctccaactctacagggagaatgctggaaaaactgtgtcactttggcttcctgtatattaatataagcactcttatccagcaatagcagctgaaacataaatgaagatgagaactcagcctacatgacctaagatttcccacaagtccagatatttaggttacacacactgcactattgtctgatttctcctctgcatcaatctggaagtccacagagcagattagcacccaacaatcttaactaagctagtatcctactctgaagaaaggcgaagctggtggagggtttccaagactccttatccttctctgtccttcctcccatcccctccttacgtcttttctgtttgtttttatttaattttttttttaatgtatttttagtcacaagaaaatcaaagaagccacctacttaagtcttaagctctgccctttgcttagtcctaatggagagttctttggccatctatgtacaagagattagaggagccaaagagactggagaaccacatcaatgggagctttttcatctaaaggtcatctgtccacactgtccaaatgaggtttaccctgtgaaataaaacttggtgtaagtgctacctgctgagaaaaatagtatgaaatgtcacacaaaggactggggtgcagcaggaggactctgaaagagtcatacgtgtaaaccagcaggtcttagaatgccctaatatactatatgaagtttcagagtaaacaaatggttaatgacacatcttttgtaacacatgaatcagctactgatttgcaagagtgggacacaccctagtacctatgactctaaagtacctgtttgaaaagtggacctagatgtttgaattgccaacccatcctaagaccggaacataattttacaactatgtaagttgccataatttaaagttaaaaagatcactgcctttcattataatggaagttaatttgagaacttcattaaaacattcacaccgataatcaaagaacagtagagatacaaagtaaaatatagccaatcaatcctaggaagcaaacacaagaggcaagagaaatggcaggtaaaggaagtgaagaatagcaaattcaaaaactacaatattcccaattctaaagaaaaatgaataaaatgaggctggtaatgaaaaaataacacatcttaccttaagaggcatccaagtagcattcatagtgtcaggatataaagacaatactcagaaatgagcaagaagtcttagtaattccctcggttaccaagtataagcaggtaggaaaatcttttgtttcgagaaggtatctgaaagagaggattttcatttagactaaaaaataatcaagacaatgcaaatagtttaagctacctgggcagggattttgaagtactatttgcctcatcgcactaaaaaagtatagaaaatacagtcccctttagaaaagggcaaatgtgtgtctccatatatatgtgtgtagaaacatactttacataaaaagagaaataaatatgtaacacgtattttagataatgtaaaattgcttatcaaacaattagccaaaatcccagagagaataaagtaattttccagggtacttcataaacactaaacgtgatttgttaactaaccgtctaaagaaagacccttgccacatttaattatatttagtaaagtaaaacttctctaatcatcccgactgtcccaagattatgcttaagtttcagagtcaattccacatgaaaagtaaaacctattcttgactgaagtactagaaacaaataaaagacccttcttccccagagatcgttaaaagcagaccgagcaacttaattttgagggtgggaggaaggtaaatttgcctggaggcaggaggatggactaaatgacctctggtaggatcctcgttcaagtcctgggcctgtatacaattccagcttaaccagttactgcttcgcttaaaatggaggcttgcctgcgtagggacaaaaataacagcacccacttcttaaaaataaatgtcgaaaagtacccctttttaaataaaaataaaaaataaacacctctggagtggatgtgttcttgctatgcgtttgtcactgaggcttcgaagacttggcatcactttccttaccgctcaccggattttgggggaggagcggggggcgacagtttgactcttgacccaagtctcaggcggacttcagagccccacaggggcccccaactccagagccagagggagcggagaggcgagagcccgagatcgcacctccccccaccgcggaccccagtcccaaacccacccctcacctccccgcagtggggcgcctccttctgccccattcccattgttagggagggcagagcgcggggtgggctcagggcaggggcgcccgcggccgttgcccggctcgcttcaggaggggcgccccgcgggatgcggcttcccttcctctccgcgtcggtccgtcccacctcggctcggcctggcgccccgaggtccgctccgcgcccccggccgcggccccggcccgccccccgggcagccaggccctcaggccagtcggccggcagccggcgtcccaggcctacgagtgggcgctgggcgggggtccccgtgccccacacacgcgtcccctctcccccagccccgccgcttccagggccctcggcggcgcccgctccccgggccccgcggccccccgcctcccagccgggccgctccctcgagctcgtcgggtcagggacacctcctctacctcaccatcaccctggcccactcgtgcccccacccccaggggcaccagtgccaaaggcagctcccccagccccggacctacctgcacggttcaaccaagcctagaagtgggggcggggaatcttccgccctcctctggcgcccattggcccttcaggggcacatcgtgagcgccattggctgagcaatggtgtccgtcagagcgatggggcgggacagaagggggagagggatgctggtgccttggcgtctctgtctctgtgtatctcgttgtctctgtctctgtctcggcccttggaaacgagaggcttttggctgagaggactagaagggggcctgaggtgggaggaataggaataggaatcctgacagagcgtcacgccagttggccactctgaacgccctacctaagtcccctttaggttctcttctccatcacccccaacccctgcccctcacccctcgaggttctttcatccaggaagcgacgtgatgaaaactccaggccggaaggccatagggagagatgttatatatgtatataaaatatacacataaaaatgtttatatataaactcaaccagatatcagttcactagggcctggaaaggaaagggcacacatctcacagacagggaaggacttgagatagagccggtagaagaaggaatcaaaaatcactctaagagctggcaacagtggttacctcctgggagaggaactgagtgcctagggaaccagtgggcggaagacttacatatctcggcatatcatttgtatccattgatttttgcaccattcatcaagattccaatttaaagaaaaggatttaaatgtttaaataaggtcgcaaaaccaggggacagacaagataattgggcaggaaaattggcgcaacatgcagatttggggaggaatcttagcttttaatatgttcagctcccggtaacagggttttgtaaaacccagtgaaggtgtcccagaggcaactgaagttatggaacttgagagagggtagacaatcaggactagagaagatgcagggtcctctgcctaaagatagtgatctatgacatgctaaaggataaactcccaaagaagggtaataagacacccacagtaaaaggtaggaggacgaaaaagaaggtcagtgaggtaaaagaaacaatattaaagaggcatgaaaattaagggaggaagggtctgtggaaaatagaataataaaactatgagagaggccgggcacggtggctcacacctgtaatcccagcactttgggaggccaaggcgggtggatcacctgaggtcaggagttcgagaccagcctgcgcagcatggtgaaacccgatctctaatagaaatgcaaaaaaaaaattagccaagcgtggtggcgcgcctctgtaatcccagctactggaaaggctgaggtgggagaattgcttgaaccgggaggcggaggctgcagtgagccaagatcgcgccactgcactccagcctgggcgacacagtgagaccctgtttcaaaaaaaaaaaaaaaaaaaaaaaaacaacaaacaaactgtgagagcctcataggtcttacctctttacctctttaggctctggtaaccatgggacaataagaatgaaagccaaggccgggcacggtggctcacgcctgtaatcccagcattttgggaggccaaggtgggcggatcacaaggtcaggagatcaagaccatcctggccaacatggtgaaaccacgggcatggtggcgcatgcctgtaatcccagctactcgggaggctgaggcaggagaattgcttgaaccagggagtcagaggttccagtgagccgatatcacgccactgcactccagcctggatgacagagtgagactccgactcaaaaaaaaaaaaaaaaaaaaaaaaaacaacacctttatcgattaagaatcttttttctgagtttattaattctatttaaatcaaccccagaaaacaccttcaacacagcctctcatttcatatctgtaaaatggggcaaaaaaaaaaatagttcctaccctttagagttgttgtgaagattaaattagtgaatacatatgatggatttttttttcttttttcttttttatgagacacagtctcgctctgtctcccaggctggagtgcagtggcactatctcagctcactgcaagctccgccttccgggttcacgccattctcctgcctcagcctcctgagtagctgggactacaggcgtccgccagcatgcccgactaattttttgttatttttagtagatacggggtttcaccgtgttagccaggatggtctcaatctcctgacctcgtgatccgcccgacttggcctcccaagtgctgggattacaggcatgagccatggcgcccggcctgtgtgatggattttttaagagcctgactggcggggtgaggtggctcatgactgtaatcgcagcactttgagaggctgaggcaggtgaatcacttgaagccaggagttcgagaccagcctgggcaacatggcgagacctcgtctctacaaaaacacacacacaaaaattagctgggtatgatggtgcatgcctgtagtcccagctactcaggagactgaggtgagggtcgcttgagcctgggaggcagaggttgcagtcagccgagatctcaccactgcatttcagcctgggtgacagtgtaagaacctgtcaaaacaacaacaacaaaaaaaacaaaacaacaacaacaaaaaaacgcacgaaaaaaaccacataagctccttgagggcagaaactgtcccctagtcttctatattttatttcacacaatgtacagaagactaaatgaataattgttagctggtttttttttttaaaggggataagatcagttacaatgtctttttcctcagtcaatcacataagtatctaaaatgacattccaaagtaaggacaggagtttaaatcctgaactatggtatctaaagtaaacttgaactttccttatttttaaaaaattttggccgggcgcggtggctcacgcctgtaatcccagcactttgggaagctgaggcgggcagatcacaaggtcaagagatctagaccatccttgccaacatggtgaaaccccatctccactaaaaatacaaaaattagctgggcgtggtggcacggacctgtagtcctagctacttgggaggctgaggcaggagaaccgcttgaacccgggaggaggagactgcagtgagccgagatcacgccactgcactccagactggcgacagactgtctcaaaaaaaaaaaaaaaagaaaaagaaaaaagaaaagaaaaaaattccatacatagaattctgtgtggcattttagagaaaatcatggtgactagagacaccaggtgaaatttttttttttttttttttggtgacacaaccccaggagatcctgtgaacatgtgtcccttgaccaggtgaatttcaggagcttgcactagtcccaggttagctggcaccaggttggccctagtttgagtgccttccacataccaggtactgtgctggagaagtaacatcaaaaaggaaaatcaaatttcatcttcaataagcaatcacaatacactgtgatgagagttagggtgaaggaggttcaggttaccatgggcttatattaggagggcaaattctgtcttcaagtctttttgcttcaacagtagcgtttagatcttgtgggctgggcatggtggctctagcctgaaatcccagcactttgggagggtgaagtgggcagactgcttgagcccaggagttgcagattagcctggcaacatggcgaaaccccgtctctacaaaaaatacaaaagtcagccaggcatagtggtgcctgcctgtagtttcagctacttgggaggctgaggtaggaggatcgcttgaccccaggagttcaaggctgcagtgagctaccatcgagccacttcacttcagcctgggccgcagaataagaccctgtctgaaaaaaaaaatcttgtgatataataacagcttgtgcactcttcgatagctcagctggtagagcagagggctgtagactgcatagataataataacagtttgcgtttttgagtcaaagatgataccccagaatcattatcgaaaataatggttgatccattcacctgtgcctatgactgtgagccacattgtgaccaatctgtgagcaacatgggtgggaatgcagtttggggccatggaactcacttaacaggaagttccaatagcagtggatttaccatgttgcggctgtaggatcttggacaaatatttaatgacctctgtctctcagttctctcaataataaaacatccctccgagagttgctgtaaaggttaacatagggggagtcttgcaaatagtaggtgctaaaatcctgtcttgaaaaaaaaaaaaaaatatatatatatatatatatatatatatatatatgaagagatgagatcttcaattgtacagactgtccctgtacccattcatttgcatttcttttcctttacaataatacatatctatgatttcctttcattcccactgtcatcaatttagttagattactgggcagagatcaccagtggggctagagtaaaatgaaaataaatgtacattgactctaggtattcctaagtaatagcacagtttactgtgttctccctcataaatcctggtagctgaatgttgcctgcttttagcagttacgtttctgctcatctcaccctcaatgttcattaagaaaatagttattgaatggccaggctcactggctcacgcctgtaatctattacaggcgtgagccaccgtacccagccttggttatcatatttctaatttataatagtttttcttgttttcttattgttcattttttatagcatcctgttcttatattatggatatatatcttcaggtctcgctgaagaaataaagaggtgtatgtgtatatatgtgtgtgtgtattatctttatttttattttttgagatggaatcttactctgtcgcccaggctgtagtgcagtggcgcttttgggaggctgaggtggaaggatcacttaaggccaatatttggagaccagccagggcaacataacaagacccccatctctacaaaaaaattaaaaattagctggccatggtggtgagtgcctgtagtctcagctacttgggaggctgaggcaggaggattgcttgagcccaggaggttgaggggggaggtgagccatgattgagccactgcactccagcctaggtgacagagtgagaccccatctctaaaaaaaaagagagagagaaataaaatagttattgagcacctactgtatgtcaggtccaagaccctaaagatgtaaagatgaataaggtggtgaccctgccttccagtttccacaaaggtggggaatatggataaaagcagacaaagccattgccatgggataagggcagagaatagcatgtgcaaattatagaaggtgagggataatataccactttccagaaactgatggttcaatgaggctaaagcatggagttcaagaaaggaaaccagatgagattaactgcaatgtggttctcaaacttaaatgtgcataaaaactggccttgttgactgggcacagtgactcacaccggtaatccaagcactttgggaggtcgaggcgggcggatcgcttgaggtcaggagttcgaaactagcctggccaatgtggtgaaaccccatttctttttttttctttttcttttttttttttttttttttttgagacagagtctcgctgtcgtccaggctggagtgcagtggcgtgatctcggctcaccgcaagctccgcctcctgggttcacgccattctcctacctcagcctcccgagtagctgggactacaggcacccgctaccatgcccggctaatttttttgtatttttagtagagacggggtttcaccatgttagccaggatggtctcgatctcctgacctcgtgatccgtccgccttggcctcccaaagtgctgggattacaggcgtgagccaccgcgcccggcctgaaaccccatttctactaaaaatgcaaaaattagctgggtgtggtggtgcacacctatagtcccagctgctcaggaggttgaggcgggagaatcacttcaacctgggaggtggagatggagtaagccaagatcaagccactgcactccagcctgagtgacacagcgagactctgtctccaaaaaacaaacaaacgaacaaaaaactggccttgtttacatagtctcgcaagctccaagcctagagatcttgatggagcgggtcagagtgctgctgctcggagggctacactctgagaaccaccgatggagaagaagggcggggtcaacttgcagagctgtgctgggaggtgtgtgctgcagccttgagggggtgaagaacctttgagaggttttaagcctgcaagagatgtggtcacatttatattttagaaaaatcaccctgtgtgcaatatgaaaaatgaaacagagagggcaagactggagtcagggagagcagttaggaggctgctgcagaaacccaggcaagaaatcataaagacctgaaataaaacaatgccagtggggaacggggaagagaggccaaatccaaggggtatttaggagccagaattgagagggtgtgatgagtgttgatgggatacaggacaggatcctgagatggcttgcaggtcttcagctttgagtgacccatggaagcgaaggaagatgggaaggagggtgcctatcacacagagagaatgaaggtttgagaggcaagtgtagcttttgacattttgcttttgaaatgtctatgggacatcagaaataatctcaaaagaccacaagtcaggcagggcgcggtggctcacgcttgtaattccagcactttgggaggccgaggtgggcagatcacgaagtcaggagctcaagaccagcctggccaacatggtgaaaccccgtctctactaaaaattcaaaaattagctgggcatggtggcgggcacctgtaatcccagctacttgggaggctgaggcaggagaatcacttgaacctgggaggcggaggttgcaatgagctgggatcgagccatcgcactccagcctgggcaacaagagtaaaactctgcctaaaaaaaaaaaaaaaccatgagtcactggttaacagcctgagcggcagaaatctcacagttctgagtctgaatcctatctagcctggctctgaaactcacaatctggagctggggcttggtgcagtggctcaggcctgtaatcccagcactgtgggaggctgaggcaggtggattgcttgaggccaggagtttgagagcagcctggccaacatggtgaaaccccatctctactaaaaatacagttagccaggcatgatggtgtgcacctgtaatcccagctacttgggaggctgaggcacgacaatcgctggagcccaggaggcagacgttgcagtgagccgagattgtgctactgcactccagcctgggcaacacagcaacactgtctaaaaaaaaaaaaaaaaatgctgggcgcggtggtttacgtctgtaatcccacttttagaggctgaggtgggaggatcacctgaagccaggagctcaagaccagcctggccaacatggtaaaacccgccatcccctccctgccatgccccatctcccccaacactctcccaccctgtctctactaaaaatacaaaaattagccgggtgtggtggcacacacctataatctcagctacatgggaggctgaggcataagaattgcttgagcccggaaggtggaggttgcagtgagccaagatcgcaccactgcactccagcctgggtgacagagcaagactctctcttaaaaaaaaaaaaaaaaagaattttttttttaaatatagagatgggctttctgtgtttcccaggctatactcaagctcctgggctcaagctattctcctgcctctgccttcaaccagcctcaatcctccaattttcttattttttatatttttcaacaccttttaaattctacattctggccagctgcagtggctcatgcctataatccagcactttgagaggttgagatatgagacttgcttgaggccaggagtttgaggcttgcagtaagctagaatggcgccacggcacagcagcttgggagacagagcaagaccttgtctcaaaagaaaaagaatttaaatactacattctaggagatttcttcaaccttcaaattttgtattgaatttttaattttggcttttatttatttattttttttttgagacaggttctcactctgtcacccaggttggaatgcggtggcttgatctcagctcactgcaacctctgcctcctgggttcaagtgattctcctgcctcagcctcctgagtagctgggattgcaggcgtggtccagcatgcccagcttatttttgtattttcagtagagacggggtttcaccatattggccaggttggtctcaaactcctggcctcaagtgatccacatgcctcagcctcccaaggtgctgagattacaggtgtgagccactgcacccagccttggctatcatatttctaatttatgatagtttttcttgctttcttattgttcattttttatagcatcctgttcttatgttatggatatatatcttcaggtctcgctgaagaaataaagaggtgtatgtgtatatgtgtgtgtgtattatttttatttttattttttgagacggagtctcactctgttgcccaggctggagtgcagtggcacaatcccagctggctgcaacctctgcttcccaggttcaactgatcctcccacctcaatctcccaagtagctgggattacaggcacctgtcaccatgcccggctaatttttctttctttgtttcttttttttttttttttttttttttttgagatagagtctctgttgcccaggacggagtgcagtggtgtgatctcggctcactgcaagctccacctcctgggttcaagagattctcctgcctcagcctcccaagtagctgggattacaagcgtgtgccaccacacccagctaatttttgtatttttagtagagatggggtttcaccatgttgtccaggctgatctcaaactcctgacctcaaatgatccaccttcttcagcccgccaaagtgctgggattacatgcatgagccaccacaccagcaaaatttttgtatttttagtagagatagggtttcgccatatgtgtgtgtgttttaagtttttctgttttcatttctcttggcatatatacctcggaatggaattactgggtcatatgggagctctgtgttaaacacttgtgtcatatctaagaaaacttgctaatccaaaggtcataaagatgtatgtctatgttttcctctaaggccaacatggtgaaacactgtctctattaaaaaaataaaaactgggccgggcatggttgctcatgcctgtaatcccagcactttgggaggccaaggtgggtggatcacctgtggtcgggagttcgaggccagcctgatcaacatgcagaaaccccgtctctactaaaaatacaaaaaaattagcagggcatggtggcgcatgcctgtaatctcagctacttgggagctgaggcaggagaatcgcttgaacgcaggaggcagaggttgcggtgagccaagatcgtgccattgcactccagcctgggcaacaagagcaaaactcggtctcaaaaaaaaaaaaaaaaattagttgggcgtggtggcgcgcacctgtagtcccagctactccagaggctgaggcaggagaatggcttgaacccaggaggtggaggttgcagtgagctgagatcatgccactgcactccagcctggcaacagagcaacagagcaagactccatctaaaaacaaaaaaaagagttttctacttttcagtctaacaaatgttttataaacaaaggctttgttatattttgagttaatttttatagataatatgaggtgaggtttcaacttcattctattgtgtgtgggtatccagttgtcccaggaccattgtttgaaaagacttttttttctacactttctctcattgaattgtcttggcatatttgttaaaaatcagttgaccttggctgggcaccatggttcacacctgtaatcccagtattttgggaggccaaggcaagaagaccatttgagcccagaagttcaaaacccgcctgggcaatataggcacactccatttctaaaaataattattaaaaagattagctgggcaggccagacatggtggctcacgcctgtaatcccagcactttgggaggccaatgcaggtggatcacctgaggtcagaagttcaagaccagcctgaccaacatggagaaaccccatttctgctaaaaatacaaaattagtctggagtggtgactcatgcctgtaaatcccagctactagggaggctgaggcagaagaattgcttgaacccagaaggcggaggttgtggtgagccgagattgcgccattgcactccagcctgggcaacaagaatgaaactctgtctcaaaaaaaaaaagattagctgggcgtggtggcacatgcctgtggtcccagtgacttaggaggctgaggcagggggatcgggagacggaggctgcagtgagccttgatcactgcactccagcctgggtgacagagtgagaccctgtctcaaaaaagaaaaaaaatcagttgaccgtaatgtgagcactcatttctggactttcaattctattccattgatctatatgtcagtccttatgccagtgcccaggggctcaactactggtactgtgaattagattttgaatcaagaagcgtgagtcttccaattttgttcttatttttcaagattgttttgtctatttgaagttccttacaatttaatgtgaattttagaatcagcttgtccatttttgcaaaaaaggtagttgggattttgatagagattgtgttgagtctgtagatcaatttgggaggcattgctatgtgaagagtagtaagtgtttcaatccatgaacacacaatgtcttttcatgtatttaagtttaatttctttcaataatgttttgtagtttgcacttccttggttaaattcattcctaagttttttttggtgccattacaaatggaattgttttattaatttcatttttggattgttcatttctagtgtatagaaattcaactgagccaggtgtagtggtgcaccacctgtagtcccagctacttgggaggctgagtcaggaggattgcttgtggccatgtttgaggctatagtgcattataattgtgcctgtaaatgatcactgcattctagcctcggcaacatagtgcagtcttgtctcttaaaaaataaataaataaacaactgatttttgtacgttgatcttgtatcctccaactttgcaaaattaatttattactattaagactttgtggctgggcacggtggctcatgcctgtaatcccagcactttgggaggccaaggcgggcagatcacgaggtcaggagatcgagaccatcctggccaacacggtgaaaccccgtctctactaaaaatacaaaaaattagccaggcgcggtggcaggcacctgtagtcccagctacttgggaggctgaggcaggagaatggtgtgaacccgggtggcagagcttgcagtgagccaagatagcgccactgcagtccagcctgggcaaaagagtgagactccgtctcaaaaaaaaaaaaaaaaaaaagattttgctttattttgtgtttggtgtggatactttaggaaccaaaagataaataaataagaacaaggtctagcactttggtcaaatttattcctaagtgtgtgtttgtaaacgatattgtaaatgaattttcttagtttcattttcagcttgctaattgttactgtatagaaatacaatttatttatttatttactttttttttttttttttgagacagtctcgctctgttacccaggctggagtgcagtggtgtgatctcggctcactgcaacctctgcctcctgggttcaagcaattctcttgcctcagtctcccgaacagctgtgattacaggtgcgtgccgcaacccccagctaatttttgtatttttagtagagatgggttttcaccatgttggtcaggttagtctcaagatgttcttttttttttttttttttatcattttatttatttattttttaatttttatttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcctgcctttctattccacaaagccgccattgtcatcctggcccattctcaatgagctgttgggcacacctcccagacggggtggtggccgggcagaggggctcctcacttcccagtaggggcggccgggcagaggcgcccctcacctcccggacggggcggctggccgggcgggggggctgaccccccccccaccggtcaggttagtctcgaactcctgacctcatgatctgctcacctaggcctcccaaagtgctgggattataggcatgagccactgcgccaggccaattttttttatatcactcttacacctgcaactttgctgaatttgtttacttgttctgacggttttgtggattccttagaatttcctacatacaagatcatgtcatatgcaaatacatatggttttatttcttcctttctaatttgtgtggcttttatttctttttcttgctaatttcctggctagaaatttaagtataatgttgaatagaggtggcaagagtgaatatccttgtcttcttcctgatcttaggagaaaaacttatagtctttcatcattaagtattacctgtggggctggatgcgatggctcaagcctataatcacagcactttgggaggccaaggcgggtggatcatttgaggtcaggtgttcaagaccagcctggccaagatggtgaaacccccatctctactaaaaacatctctactaaaaatataaaaacttggcggggtgcagtggctcacacctgtaatctcaccactttaggaggccgaggcgggcagatcacgaggtcaggagatcaagaccatcccggctaacacagtgaaacccatctctactaaaaatacaaaaaaaaaaaaaagaaaattagctaggtgtcgtggcacacgcctgtagtcccagctacttgggaggctgaggcaggagaatcgcttgaacccgggagacagaggttgcagtgagccgagatcacaccactgcgctccagcctgggcgacagagcaagactccatctcaaaaaaaaaaataaacgtaaattagacaggcatggtggtgcgcacctgtagtcctagctactcaggaggctgaggaaggagaattgcttgaacctgggaggcagaggttgcagtgagtcgagagcatgccactgcactccagccagggtgacagagtaagactctgtctcaaaaaaaaaaaaaaggatttatgggaagtaattaaggtcaaatgaggtcataaagctgggcactgatctaatagaattagtgtctttatgagacgagaacccagagagctccctagctttctctctgccacatgaggccacttcaagaaggcaagccaggtaataaagcccacgctgaggtaggaggtggaactggactccagagatggggcttggacaccagaccaaattgatgactagctgaaacagggacagggtgaaagcagctttccataagacacgctcaaccagtgcaccatgtcagcttaccatttccatggcagaacccagagttaccaccccaccgccttttttttgagacggagtctcactctgtcgcccaggctggagtgcagtggcacagtcttggctcactgcaagctccacctcccgggttcaagcgattctcctgccttagcctcccgagtagctgggattacaggcgcctgccaccgcgccaaactgatttttgtatttttagtagagacagtgtttcaccatcttggccaggctggtcttgaacttttgacctcatgatccacctgccttggcctcccaaagtgctggaattacaggcctgagccactgtgctcagcctaccacccctttcaatggcaacaacttgacaacccagaagttatcagcctttttctagaaacgtctgtatagtctgccccttaatttgcatgtaattaaaggtcaatgtaaatatgactgcagaactgccctgagctgctactctggtcacactacctacagggtagccctgctctgcaaggagcagtccctctgctgttgctataggccactgcttcaataaaagttggcatctaggccaggtgcagtgggtaatgcctgtaatcccagcactctaggaggctgaggcgggtggatcatttgaggccaggagtttgagaccagcctggtcaacatggtgaaaccccatctctactaaaaatacaaaaaaattagttgggtgttttggcgcacacctgcactcccagctactcaggaggttgaggcgggagaatcacttgaacccaggaggcagagtctgcagtgagccactgcactccagcctgggtgacagagtgagaccctgtcccgaaaaaaaaaaaagttggcctctaacaccttcggtttgcccttgaattatttcctgggtgaagccaagaaccctctcagtctaagccccagttttgtggcttacctgccctgcatcaacaccagaaacttaaccctttgggaatctcgatcttggactttctagcctctagaaccatgagaaaatgatctgtattattaggctacccagtctatgatattctgttgtagcctggggtgactaagacattgagcctgtatgacttgaattttgttacctgcttggccccttgatggcatttcagtttgtgactcttggtttacgtgatcacgaagccaaaactgtttaggaaggaagcaaaatcaagacagattaaaaataaaaataaaaaataaaaggctgggcaccgtggctcacgccctcccagcacgttgggaggcaaaggtaggcagataacttgaggtcagcagttcaagaccagcctggccaacatgatgaaaccacatctctactaaaactacaaaaattagccaggcgtggtggtgggcacctgtaatcccaggtatttgagagggaggcaggagaatcacttgaacctgggaggtggaggttgcagtgagccgagatcacaccactgcactccagcctgggtgacagagcaagactctctctcaaaaaataaaataaaataaaataaaataaaataaaataaaataaaataaagagccgagcacgctggctcacacctgtaatcccacacttcgggagaaagaggtggcaggattgcttgagcccaggagtttgataccagcctaggtaacatggcaaaatcccatctcaattttaaaaaaattttaaaaaagaataatagggctgggcacgatggctcatgcctgtaatcccagcactttgggaggccaagatggatggatcacctgaggttgggagtttgcgaccagcctgaccaacatggagaaaccccatctccactaaaaatacaatattagcaggtcgtggtggcacatacctgtaatcccagctactcggaaggctgaggcaggagaatcgcttgaacctgggaggtggaggttgtggtgagccaagatcgtgccattgcactccagcttgggcaacaagagtgaaattccatctaaaaaaaaaaaaagaaagaaagaaataaggtattttacataaagattaaaaagaaattaaaaccattatttgaagataatggcttaaacagaaactctgcaaatccttagaataagaaagttcaggccaggtgtagtggcttgtgcctgtaatcccaatgcattgggaggctaaggtcggaggattgcttgagcccaggagtttgagacaagccgggtcaacataatgagatcgcatctctacaaaaaattgaaaaatgagccaggtgtggcagtgcgtgcctgtagtcctggctactcaggaggctgaggtgggaaggtcacttgagcctgaagagttcaaggctacagtgttatgatcatgccactgcactgcactccagcctgggagacagagcaagaccctgagaccctgtctcaaaaaacaaaataaaaaaccctcactatattgaacacaacatcaatgttcaatagccactctccttctccttttctaataaaattccacttttttgtgttccatcccaggaccacgatttatctaaactggtcattctggatcaataagtttggctaaaaataaataatatcgaaattggtcacaggaaatctattcttttttttttttttttttttttttttcagacaaagtctcactctgtcgcccaggctggagtgcagcagcatgatcttggctcactgcaacctctgcctcccgggttcaagcaattctctgcctcagcctcccaagtagctgggattacaggtgcctgccaccacgcctggctagtttttgtatttttagtagagatggggtttcaccatcttggccaggctggtcttgaactcctgaccttgcgttctacctgccttggcttcccaaagtgctgggtctgtcacccaggctggagtgcaatggtgcaatcatggctcactgcagcctcaacctccctgggctcagatgattctcccaccttagcctctcaagtagctgggattaaaggcatatgccaccatgcccagctaatttttctattttttttgtagagacagggcatccctaccttgcccaggctggtcttcaactcctggtttcaaaggatcctcctgcttcagcctcccaaagcactgggtctattattccctttcatattcaaacttaattctgcattttcaaggccttgaattttcaagggcagctttttctgtccctgaacttaatcttcagctcctctcacctcctgggaggttggggggtggggaagaaaagtcccaaccctctaatcctgctttggtcttttgccgccagcccccatcctgaagctaccagtcaatttgtttgcatacaagaagatatcactttggagattctaagtgtatacgaggaaatgaggtcaaagaccaaatatatatatttcactatatcacacttcaaacttttgtttactgtttcccttctcctactctattataaacctttgagggtggggactgtgagttatttatctttatattcccagtgtcaagagtgtttagctataatgggaatgaatctcaaagtttcttgaataaatgacaagaagaatcatagttgcatgaactaaattcattattctcagtccttgaggtaaatgaatatattgatattatgtctgcttactctttttttgcgagagagagaaagaggagggagggagggaaggaaggaaaaaaggaaggaaggcgaaaagagtgaaagaaaagagagagaaaaagagagagaaagaaggaaggggagggaaggaaggaaaagaaggagggaagaagggaaagggagggagaggaagaaaagaaagaagaaggaaggaaagaaagaaagaagaaaaggagggaggaaggaacgaagaaagggaaagaaggagggagggagggaaatgaaggaaagaaagaaaaaagaaagaaagaaaaaagaaaagaaaaggagggaggaaggaaggagggagggaaggatggaagaaagggaaagaaggagggaggaagggacatgaagagaataaagaaagaaagaagaaaagaaaagaaaaaagaaaagaaaagggagggctctgcgggcggcggcggcgcggggagccggttgcaggccgagatgctgcagatggacctgatcgacgcgacgggggacactcccggggccgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgcagttgtctcaggacacactgaataataattctctgggcaaaaagtacagttggcaggatcgggtgtctcgatcatcctcacccctgaagacaggggagcagacaccaccgcatgaacccatttgcctgagcgatgagctgcccccccagagcagccccgcccccaccacagatcgaggcacctccaccaacagcccacgctgctggagctggtgagcctgcggccgtgcttcagagactacagtgacgagagtgactcggccatcgtctacgacaactgtgcctccgtctcctcgccctatgagtcagccatcggagaggaatatgaggaggcctcccggccccagcctcctgcctgcctctccaaggactccacgcctgacgaacccgacgtccatttctccaagaagttcctgaacatcttcatgagtggccgctcccgctcctccagtgccgagtccttcgggctgttctcctgcatcatcaaccgggaggagcaggagcagacccaccggaccatattcaggtttgtgcctcgacacgaagacgaacctgagctggaagtggatgaccctctgctagtggagctccaggctgaagactactggtacgaggcctacaacatgcgcactggtgcccggggcatctttactgcctattacgccatcgaggtcaccaaggagcccgagcacatggcagccctggctaaaaacagtgactgggtggaccagttccgggtgaagttcctgggctcagtccaggttccctatcacaagggcgatgtcgtcctctctgccgctatgcaaaagattgccaccacccgccggctaaccgtgcactttaacccgccctccagctgtgtcctggagatcagcgtgcggggtgtgaagataggtatcaaggccgatgactcccaggaggccaaggggaataaatgtagccactttttccagttaaaaaacatctctttccgcggatatcatccaaagaacaacaagtactttgggttcatcaccaagcacctcgccgaccaccggtttgcctgccacgtctttgtgtctgaagactccaccaaagccctggcagagtccgtggggagagcattccagcagtttcacaagcagtttgtggagtacacctgccccacagaaaatatctacctggagtagccgcgcagccccgccctctgcgtcccccggccctcaggccagtgccaggacagctggctgctgacaggatgtggcactgcttgaggaggggcacctgccaccgccaggggatgaggaagtgggggccgctggctcagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccatacctcccctgccagggctcgggtgctctggctcctgccttgatgaagcccatgtcctgccttgatgaagcctgtgccacctgcaagtgcccgccctgcccctgtcccaacacccaccgaagagccctgagctcaggctgagcccagccacctcccaaggactttccagtgaggaaatggcaacacatggaagtgaagtccctgttctcagctctgtcatctgcagggcttctgggtggctcctgccactgacctcactggcatgctagcctgtggcaggcctaggacctcagcggggaggaggagctgctgcaaggccctatcccagcaggagagggaggcttcctgactgacacaggctagccccatcttggtcctgtcaccctggccccaactattaaagtgccatttcctgtcaaaaaaaaaaaaaaagaaaagaaaagaaaagggagggagggagggaggcaggaaggaaggaagagagggagggagggaagggaggaagaaagggaaagaaggagggagggagggaaatagaaagaaagaaggaaagaaaaagaaagaaagaaagagaaataaaataaaaattaaaaaaccataaggttaaagtaaaccctttttcttcatacagattaaaacacatgacttcaaattacagctttgcttcttaatagcttggtgatgtaggacgttatgtaacctctctgtgcctcagtttcctcatttataaaatagggcaataataatatctagcccataaggcattgtgaggattaaatgtgaaatgctgatcacaaatacctagcagcccaatagatactcactgtaataattattatttttataatttctgcaaaagtatggtgatgattcttgggttaacctaaaggcagattttcttttatttcttcctgtttcttttcttttccttgttcactttaaagaattaaaaagaaaattgattccagcattttggaataaaaatttgcatcaaaaagaatttattcattttattgacatacaaataaaatgtcatttgtttattcaataaacatttattaaatgtctggtaaatttcagacatcatgccaggcacagggatgacaatgacaataagatgtggtctctgccctcagggagctgatagtccaggagactgacaagtagacaggtgattacatgcaatgtaacaaaggctatgatgtcatacaagaagacaagtgggagtatgtgatgggagtatggttttgaccagttcctcctcttagatttatccctttttctttggctataaagcaaaagaattggtcctatttttttttcttaactttgcaaattaaaccataaattttaataactttataaagataaaaggcaagcggtcagattcagtggctcacacctataatcccaacactttgggaggccgaggcaggtggataacctgagatcaggagttcgagaccagcctggccaacatcgcgaaaccctgtctctactaaaaatacaaaaattagctaggtgtggtggcaggcacctgtaatcccagctactcaggaggctgaggcaggagaatcgcttgaacctgggaggcggagtttgcagtgagatgagatggagccattgctctccagcctgggctacagagcaagactctgtctcaaaacaaaacaaaacaaaacaaaacaaaaagatgagcaacttgaattatggaggacactagaaatagtgtttcctacagaatcagggcttcctaccaacatagtcacttctagggttttcgacctgaaaagttctgtggcatattgtttctttgctatccacttttttttccctatttttccccctctttctctcctctactttatctcctagagatctaggtagttcccaaaggaataatgctttacggagtctaatgttgatttattaggtaaaaacagaaaatgacttttttttttacccacaagttccataccaaaaaatgaatgtaaacttcttatgcagtttcacacattgaaaatgcaggttattttaattccattgcatttttcagaattctcaatcgcaatcctctgacaactgttgaagatccgtatctctttaaattactggcattaaaatatctgtaagtactatagtactcttgggagtcatgagatgatttatactctttttaaatttttcatcaaagattaagtattttgcatttaggctaaaatgtcataatttaaattttaactgagttattgaaaaacattattggcaaaggaaaggatgtgtaatggtcaagatagccagcaggggaaagagaacagtgttgaagaacccatatagatttggaacatgtagacacatggaggaatattacttaaccaagaaagcaaaggggaaaaggtgttcattattctaaaaaggaagaaaagagtaaataatcaagatgggtgaatgcaatatgaaaatgagaagtaagataatggtaaaaaaaaaaaacagtgtaagacctactcttgaatatcattaatttgatgatgcaaatcaactttaatttctttaataagagctctctggaattttgcggcaaataaactgttgaactggcttgttttatagggaagccaaaattgaagtaatcacatgtccttgaattatctttttaagtacagaattttttactggggttcatatcatgaatgtttcggctttcttcttcagagacgtgggaacaacgcaagtcccacttacaacacttaagaacattctcatgatgaccgttgaactggaaaaactgtaagttatttttttcttagacttattttcaccctgttgcgtttttaggtttgttttattattttcttaagtcaggtttattgagatataattttcatatactaacattcaccctttttaagtgtacaatttgatgagttttgacaaatgtatagttacataaccaccaccacattcccaatataaagcatttctgtcgcctcaaaaaggtccctcgtgtccctttgtagtcaatcacctcctcccaccgtcagcccctgttagctactaatctgatttcctatagttttgccttttccagaatatcttataaatgaaatcatatagcatgtagcctcttgtatttgacttctttcacttagcataattttttcttttttgagatggagtctcactgttgcccaggctgcagtgcagcggcatgacctagactcactgcaacctccacctcccaggttcaagtgattctcctgcctcagcctcctgagtagctgggattacaggcacatgccaccacgcctggctaatttttgtatttttagtagagacgaggtttcaccatgttggccaggctggtttggaagtcctgacctcaagtgatccgcccgccttggcttcccaaagtgctaggattacacgtgtgagccacctcacctggcctcacttatcatattattttttgaaattatgctgccatccatgttgctgcacccatcactacagctggccctccatatctgcaggttcctcatccatggattcaactgaacatggatggagaatacttgaaaaaaatgaaatatataaaataactataagacaataaaaacagtagaaaatttaaaatacagtataattatttacataccatttacactgtattaggtatttaaagtatacctgaggctatatacaaacattatgtcatttcatagaaaagacttcagcatctgtggactttggtgtcggcagggggtcctggagccaatcccctgcagacaccgagggacaactgttcactcctttttattgctcagtagtattccagttgtgtggaaaccccatctctactaaaaatacacaaattagccagatgtggtggcacacacctgtaatctcagctactcaggaggctgaggcacaagaagtgcttgaagctgggaggtggaggttgcagagtctcctttacacttgctgtcctccctccactgccgcctgacacactcctccccagcagtggcctcttcataggcaaatttaaggagcaccttttagtccttgtcctgcttgacttggccctgatgtttgaaattcttgataaatctttcttccggaaacacactctttctatgcttccaggaaatctttttcttggttctccagacaacttcttagactccttgaccaattccttcttgttgccaacaatggaaacaaaccagccctacctaagcaaagcacattaaaactcactagaaagatacaggggagggggcgcccactaaaccactaaagagacaggaggtggggagctgtaggaccaggtttgggaacctgcaagaatcaagaccagagcccctgaaatagcaagaagctggaagcacaggaactgtcagagccagatggctgtcactgcagtcagcgcctctgattgtttgtttttgagatggagtctcgctctgtcgcccaggctggagtgcagtggcatgatctcggctcactgcaacctccacctcccgggttcaagcaattctcctgcctcagcctcccgagtaactgggactacaggagcctgccaccatgcccgactagttctttatatttttaatagagatggggtttcaccatgttcgtctcaaactcctgaccccaggcgatccacttgcctcggcctcccaaagtgctgggattacaggcgtgagccaccatgcctggccagtttttgtatatttagtagagactggttttgccatgttggccaggttggtctcaaactcctgacctcaagtgatccatccacctccgcctcccaaagtgctgggattataggcatgaaccactgtgcccagccacctctgatagttttcatcgtcctcgggccactggctcccaaatcacggttccagacaaaagcttacaagtagtccagctttggccaggctcagtgtgatggttaatactgagtgccaacttgattggattgaaggatacaaaatattgatcttgggtgtgtccgtgagggtgttcccaaaggagattaacatttgagtcagcgggctgagaaaggcagacccacccttaatctgggtgggcacaagctaatcagctgccagcaaggctagaatataagcaggcagaaaaatgtgagagactggcttagcctcccagccaacatcttcctcccgtgctggatgcttcttaccctccaacatcggactccaagttcttcagttttggaactcagactggctctccttgctcctcagcctgcagacggcctattgtgggaccttgtgatcctgtgagttaatacttaataaactcctgtatatattccattaattctgtccctctagagaaccctgactaatacgctcagtgactcacacctgtaatcccagtactttgggaggctcaggcaggaggatggcttgagccccagagtcttcttcttctccttctccttgtccttctcttcccttcccctttctcctcttcctcttccttctcttcctcttcctcttcctctccttcctcttcctcttcttcctcttgtttgtttgagaaaggttctccctctgttgccaaggctggattgtagtggcacaattgtgactcactgcttctcagcctcctgagagcccaggagtttgaggctgcagtgagctatgatcacactaccacactcctgcctgggtgacagagcaagaccctgtctcaaaaaacaaacaaaaaactctggtatgatagaggtgaattgtctgttttatcctgataattctgcttaccttagtcccgtggttctcaactgggccaattttgctccccaagtgacatttggcaatatctgggcagaggtcaaggacgctgcttaacatctttttttttttttttttgagacacagttttgctcttgttgcccaggctggagtgaaatggcacgatctcgcctcactgcaacctctgtctcccgggttcaagcgattctcctgcctcagcctcccgagtagctgggattatgggcatgcaccatcacgcctggctaattttgtatttttagtagagatggggtttctccatgttggtcaggctggtctcaaactcccaaccttaggtgatcagcccacctcagcctcccaaagtgctgggattacaggtgtgagccacctcacctgtcctgcttaacgtcttaaaacacacaggacaattcccccataaaaaatgatgaccagccgaaaatgtcaacagtatcaaggtgaagaaattgccataaaggcttggtaaacagggatggtatgacgacactattgataggccacattaaaatacttagggccatatccattatccctgtttttatgatttcttctttgtccccatgcagtttcaggggcaaaataagggagtaagtcagaggtggttccaaatagacatctgggaatcttagggtgtaatatggccctcatggaggcccttgctgagcttagggcctgattctggaatcctagcattgccaagagaggcaggctggcaggtgagaagacaaataatgggagagcccacatatgttggaattcatttgatggtatctaagctggggtgattgtccccactagcattacatgactatggatccagttatttggagaaatccatttcctccacagggaatatatactacattagaaccaaagatggaatccttagtaaatggaatcatttggcaaaattcagttgtctgaaatttttgcataaaattctcttttttattttcattgagccaaataaataaagtatcaggtatttactggggtcaccattctttgattcattgattttttttttcagacaggatctcgctgtcacccacgttggagtgcagtggcataatctcagttcactgcaacctccacttcctgggcttaagtgattctcccacctcagcctcccaagtagctggaaatacaggcgcgtgccaccatgcctccattttctttctttttttttttttttaattgatcattcttgggtgtttctcgcagagggggatttggcagggtcataggacaatagtggagggaaggtcggcagataaacaagtgaacaaaggtctctggttttcctaggcagaggaccctgcgccttccgcagtctttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtatagaacaaaatgaaaagtctcccatgtctacccgcctctacacagacacggcaaccatccgacttctcagtcctttccccacctttcccccctttctactccacaaaaccgccattgtcatcatggcccgttctcaatgagctgttgggtacacctcccggacggggcggctggccgggcggggggctgacccccccacctccctcccggacggggtggctgccgggcggagacgctcctcaattcccagacggggcgactgccgggcggaggggctcctcacttctcagacagggcggttgccgggcggaggggctcctcacttctcagacagggcggttgccgggcggagggtctcctcacttctcagatggggcggccgggcagagacgctcctcacctcccagatggggtcacggccgggcagaggcgctcctcacatcccagacggggcggcggggcagaggcgctccccacatctcagacgatgggcggccgggcagagacgctcctcacttcctagatgggatggcggccgggcagagacgctcctccctttccagactgggcagccaggcagagacgctcctcacttcccagacggggtggcggccgggcagaggctgcaatctcggcactttgggaggccaaggcaggcggctgggaggtggaggttgtagccagccgagatcacgccactgcactccagcctgggcaccactgagcactgagtgaacgagactccgtctgcaatcccggcacctcgggaggccgaggctggcggatcactcgcggttaggagctggagaccagcccggccaacgcagcgaaaccccgtctccaccaaaaaaatacgaaaaccagtcaggcgtggcggcgcgtgcctgcaatcgcaggcacttggtaggctgaggcaggagaatcaggcagggaggttgcagtgagccgagatggcggcagtacagtccagcatcagagggagaccgtggaaagagagggagagggagaccgtggggagagggagagggagggggaggggagggggagagggagagggagaggtgcattttcttataaacccaatttcctctttagtgcaactctaccatttgaaaggaacctttctattgtaatttacaagctgtgaataaccgctatgtaattctttccaaggattaataaactgagagaggatttgaaccaacagaggtaggggaagattagaagggggatgcaagtggccacagatcttagaggcggccagcagagggcgctgctccaaggtgaaggtcgcaccctgagaggccatccttttttgtaggaccagactggggtgtaaggacagtgcctcatcctcacaacgacagacccgtgttctgggtgtggatttgcctcccttgcctgcgggacttctgctagcactgccgttcctagacttagaccatgctagaatgagtccaggaaccgaggagaggagatgggagtggctcctcccactgtggcccctaataattcacatgaagaatttttgctttccttgccagggacccgggactcagtgggtccagaggtcctagtgccaaaggaagaaatgtgtagatcaggaaatactattatggttttattcaactggaagccgaggctggccatttattgtatttatttatttatttatctatctatttatttatttatttagagacagaatctcactcttgtttcccaggctcccaggctcaagagatcctcctaccttagcctcctgagtagctggtactacagtcgcatgccaccttgcccagctaattttttttttttttgagacgcagtctcattttgttgcccaggctagagtgcagtggcgcggtcttggctcactgcaacctccacctcctgggttgaagcgattctcctgtctcagcctccggagtagctgggattacaggcatgtgccaccgcgcctggcaatttttttttttttagtagaggcggggtttcaccatgttggccaggctggtctcaactcctgaccttgtgatccgcctgcctcagcctcccaaagcactgggattgcagacataagccaccgcgcctgttttttttgttttgttttgttttctgacagagtctctgtcacccaggctggagtgcagtggtgtgatctcagctcactgcaacctctgcctcctgggttcaagcgattctcctgccttagcctcccaagtagctgggattataggcgcacaccactatgcccagctaatttttgtatttttagtagaggtggggtttcaccatgttggccaggctggtctcaaactcccgacttcaggtgatccacccacctcggcctcccaaagtgctgggattataggtgtgagccatcaagcccagccctgcccagctaatttttacactatgggcaagtatgctgcccaagagtgctctggaactcctgggctcaagtgatcttccttcctcggcctctcaatgtgcttggattacaagcatgagccaccttgcccagccgaagctggccatttaaagttcctcatgctgctgaatcaataaggatggaaggcggctactattatgggctaagtgtttgcatcctccccaaattctttttttttttttttttttgagatggagttttgctcttgttgcccaggctagagtgcagtggcgcgatctctgctcactgcaacctccacctttcaggttcaagtgattctcctgcctcagcctaccgagttagctgggattacaggcatacgccaccacacccggctaattttgtatttttagtagagatggggtttctccatgttggtcaggctggtctcaaactcccgacctcaggtaatctgctgacttcagcctcccaaagtgctgggattaccagcatgagccaccgcgcccggcccccaaattgttttttgttttttttttttgagacggagtctcgctctgtcacccaggctggagtgcagtggcatgatcttggctcactgcgagctctgcttcctgggttcacgccattctcctgcctcagcctcccgaatagctgggactacaggcgcccgccaccacgcctggctaattttttgtatttttagtggacacggggtttcaccgtgttagccaggatggtctcgatctcctgacctcgtgatctgcctgcctcagcctcccaaagtgctgggattacaggggtgagccaccacacccggcctcggcccccaaattcttatgttgaagccctcacctccatgtgatggtattagaaggtggggcctttgggacgtaattaggctgacagtgccccatgatgggatgagtgtcttaaaagaaaagaccaggtggtctggctagtggctcacccctgaaatcgcagcactttgggaggccaaggtgggtggatcacttgagatcaggcgtttgagaccagcctgggcaatatggtgaaaagccatctctactaaaaatacaaaaattagctgggcgtggtggcgcaagtctgtaatcccagctacttgggaggctgaggtgggagaatcgcttgaacccaggaggtggaggttgcagtgagcccagatcatgtcattgcactccagcctccaacctggacagagagagcatctggagagtctctgtctcaaaacaaaaagaaaaaaaaaagaagagaccagagagcctttcttctctttgtccaccaagtgaagatatggcaagaaggcagccatctgcaagctaggaaaagagcccttgccagcacccaattgtgctatcaccctgatatgggacttcccagcctccagaactgtgagtaatcaatgtctattgtttaagccacccagtatgtaatactgagctgactaaaaccatcaccgaactagcctctttacatatgattagcaagaggaaaatggctctgttacttaatggaggaaggaggctatgtctgaaagccaaaaattcactggggacacatcttagcaggctcttgaccctaagacctggttaatggaaaagtagagcaacccaataaaaacaagaccaccaagaagtcaggtcttatggaataaagtattgagtgtccctatgaggcacagaacccttcgaaaggggattggaagaagtggtgaagaaggcggctatgattatcaacttagacttcatcgccatttgtagaaggaggcttctaacagctatgttttatgttaattggctcttttctcttcttttttctttcaaccttatattaagagcactggcagaagctagcggttttggcatcctgtaattattagctgtataaccttggccaagtaactcaacctttctgtgcctcagttactcatctgtaaaacagggtaataagtctcaacctcgtacttatgttgttataaagatttaacactaggctgggcatggtggctcacacctgtaatcccagcactttgggaggccgaggagggtggatcacctgaggtcaggagttcaagaccagactggccaacatggcaaaaccctgtctctactaaaaatacaaaaaattagctgggtgtggtggcacgtgattgtaatcccagttactcgggaggctgaggcaggagaattgcttgaactaaacctgggaggcggaggttgcagtgagccaagatcgtgccactgcactctagcccaggcaacagagttagactctgtctcaaaaaaaaaaaaaaaaaaaaagtaacactttgaacaaaaaagaaaaaaataataaaatttaaaaaagatttaacaattgggccaggcatagtggctcatgcctgtaataccagcactttgggagcctgaagagggaggattacttgaacccaggagttccagaccagcctggacaacaaagcaagactttgtttctacttaaaaaaaaaaaaaaaacaccaaagtcaggtgtggtggtacacacctgtgatcccagctacttgggaggctgagatgggaggatcccttgagccttggaggttgaggctgcaatgagccatgatcataccactgcactccagcctaggcgacagagtgaggcccatgtcaaaaaaaaaaaaaatgatccccaacatttagcagcttaaaacaaaaaacatttattatatcacactttctgtgggccaggaatctgggagggacttagctgggtggttctgctcagttctcttgggatgtttcagtcaagcagtggcctggggctgcactcttatctgaagactcaattgggagaaaatatgcattcaaggtcactcattggttgttggcaggctgtagttccttactgaatattggttgaagacttcattggcttactacctggacttctccatagactgcttgaatgtcctccccacatagctagagtgaatgactaaaaaagagagagaacacacacagcccaggtaagagttcagtctttctaagtcattatatgaaagagattcttttttttttgagatggagtctcgctctgtcgccaggctggagtgcagcggcacgatcccagctcactgcaacctctgcctcctgggttcaagtgattctcctgcctcagcctcccaagtagctgggattacaggcgtgtgccactatgcccagctactttctgtatttttaatagagatggggttttaccatgttggccaggatggtcttgatctcttgaccttgtgatccacctgccttggcctcccaaagtgctgggattacaggcgtgagccaccacgcctggccgaaaaagattcttgcacacacatgtttatagtagcactattcacaattgtaaaaatgtggaaccagtccaaatgcccatcaatcaatgagtggctaaagaaactgtggtatagatatacagtggaatactactcagtcataaaaaggaatgaattaatggcatttgcagcaacctggacaggattggagactattattctttttttttttttttttttttttttgagatagagtctcacttggtcacccaggctggagtgcagttgtgcaatcttggctcactgcaagctctgcctcctgggttcacaccattctcctgcctcagcctcccaagtagctgagactacaggcgcctgccaccacgcccggctaattttttttttgtatttttagtagagaccgggtttcaccatgttagcctggatggtctcgatctcctgacctcgtgatccgcccacctcagcctcccaaagtgctgggattacaggcatgagccaccgcacccggcctattttttttttttttttttttttttttttttttttactaaccaggggtttaacataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaataaagaagattcatgctaagctgtggcagaggggggaaggtatgatcgggtgggggtgggataaggaatggccatggaagataactgggtcaggttggaccctgggctgggagggggagggcaaggcccctcaccacaacttaagccaaacctaagctgcccccaggtgccataggtccctgtcccagcagggaggctgatgggcctgggcccatgcccctccccacctttgggggtcagatagtggccacccaggtttgctgggttggggcctgatacaggctctgcatgcccattcgggctgcctgtggagagagaatggagtcactgtttaaccatgctacctgcctcagccccagcagaccacaggaggttggccccagactcactgagtgcctgcagcagccctacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttgggaccctaacttgtcccttgccaaggccaactggctgccctctggctgtggggaccgcaaggagggacccacaagctgctggcgaagtcgctgcttcagttctggcttgagccactccacagccacctgctctccacagaggtgtggctgcccttcctccagggcctttttggccatggcagcggtccagtgcgagctgaatttgagcagagcgatctgcccgggcgcaggtccggggctgggcagcagccgcgcctcctgcaggccgggacccagcggctgcagcgcgggcagcagcgcgggcagcagcgcggtgcgggtcagattcggcggcaggcagtcaacgctcagctcacacttcccggtgctgcggcacacgagcagcgggcaggacggccgcagcgggtggttgtgcagcgggcgatggcggcctgcgcgccgcgccgcgagctgcagcgggcatatgcgaagccgcggttcaggccgctgaaggtcatcatcaggcggaactcgtagaggcggcccacgcgctggaacagcaggatagctggtgctcatacacttcctgaggcagccgcccgatgaacacctctgacccagccggcggcgggctgcccacccagcctgggggtggcccgccatacttcctctgcccgttcacctgcaccaggcgatgcctgtctccctgacccacgcctccagcgccgccttcaccctctcacaccacagctcacaatcccgcttggactgcatggctctctattctcttttttttttttttttttttgagacgtagtttcactcttgttctccaggctggagtgcaatggcgggatcttggctcaccgcaacctccgcctcccgggttcaagcgattctcctgcctcagcctcccaagtagctgggattacaggcatgcgccaccatgcctggctaattttgtatttttagtagagacggggtttctccctgttggtcaggctggtctcaaactcccgacctcaggtgatccacccacctcggcctcgcatagtgctgggattacaggcatgagccaccgtgccccgtctatggagactattattctcagcgaagtaactcaggaatggaaaaccaaacatcgtacgttctcactcataaatgggagctaagctaggaggatgcaaaggcataagaatgacacagtggactttggggaatcagggggaaaggatgggaagggggtgagggataaaagactattaattgggtgcagtctatattgcttgggtgatgggtgcacacaaatttcacaaatcaccactaaagaacttacttacgtaaccaaacaccagctgttccccaatatcctatggaaataaaaatttttttttagaaaaagagttcggtctttctgtaacctaatcttggaagtgtatattatcacttcttccataggctatcagtctcccagaccaaccctgctacagggtaggggagactacatggtatgtgaataccagaaagtgggggccactggggactggctatttggaggatggttactacaaactatatttgtaattttttttttcttgagatggagtcttgctctgttgcccaggctggagtgcaatggcacgatctcagctcgctgcaacatccacctcctgcgttcaagtgattctcctgcctcagcctcccgagtagctgggattacaggcacgcaccaccacacccagctaattttttgtatttttaatagagatggggtttctccatgttggtcaggctggtctcaaacgcctgacctcaggtgatctgcccgcctcggcctcccagagtgctgggattacaggcccgagccatggtgcctggctatatttgtaatattttaaccactaaaaaaaaaaaaaagaagaagaagaagaagaaaaagaaacaagtatgggaaaatattaagatctgataaaaccgggttatacttatgcaggtattcattacattattctccataactttttaaatgtttaataataaaagtaaaaatattttccccttaaaaatgtgcagagcatacctcaaataatgttgacaaagaatcctaaagacaattattattattattattttttgagacaggttcttgctctgttgcccaggctggagtgcagtgatgccacctgagctcactgtaaactccgtctcccgagtttaagcaattctcctgtctcagcctcctgagcagctgggactacaggcgagcaccatcatacctggttaatttttatattttcagtagagacggggtttcatcatattgcacaggctggtcttgaactcctggcctcaagtgatccacccaccttggcctcccaaagtgctagcattacaggcatgagccactgcaccgggcctctcaaactcctgacctcaggtgatccacctgccttggcctcccaaagtcctggcattataggcgtgagccactgcgcccggccgatcttccttcctttctcccttcccctcttcttcttcttcttcttcttcttttttaattaatagagatgggattttgccatgttgcttaggctggtttcaaactcctgggctcaagctatctgctcgcttcagcttcccaaagtcctgggattaagggcgtgagccactgcgcctggccccagtaaggatttaaaagctcaggaattattagtcagcttccttttttgttcatcctgttgtttgttcatttcagtctattccctttttataatttccttcttcataaggactatttctccttgtacttttgtgagaattcccgtaacttgtaatcccagctacttgggaggctgaggcaggagaatcacttgaaccgggaggcggaggttgcggtgagccgagatcaagccattgcactccagcctgggcaacaagagcaaaactcggtcttggaaaaaaaaaaaaaagaaaagaaaagaaaaaagaaaggaaggaagatcctcattggacagagcaaaaagcagaattgatggcactgaaaatgaaatcagcagctgatgtacaagttccagaatgtctcctagagtaacaaggaaatccgggtgtggtagtttatgcctgtcatccaagcactttgtgaggccaaggaggttagttagcttgagcccaggagttggagaccagcctggccaacatggtgaaaccccatctctacagaaaatataaaagttagctgggtttggtggtgggtacctgtagtcccagctactctggaggcgaaggagggaggatcacctgagtcccgcgaggtcaaggccacagtgagccttgatagagttttgccactgcactccagcctaagcaacagtgagaccctgtctcaataaacaaacaaacaaacaaataaataattgtagagacagaagataaaatggagcccggtgcagtggctcacgcctgtaatcccagaactttgggaggctgaggtgggcagattacttggcccaggagtttgagaccagtctgcccaacatggtgaaaccccgtctctactaaaaatacaaaaattagccaggcatggtggtgtgtgcctataatcccagctacttgagaggctgagacaggagaatcgattgaacccaggaggtggaggttgcagtgagctgagatcacaccactgcactccagcctgggtgacaaagccagactctgtctcaaaaaaaaaaaaaaaaaaaaaaggctgagcacggtggctcatgcctgtaatcccagcactttgagaggctgagccgggcagatcacctaaggtcgggagtttgagaccagcctgaccaacatggagaaaccccgtctctgccaaaaatacagtattagcaggtcgtggtggcacatgcctgtaatcccagctacctgggaggctgaggcaggagaatcgcttgaacctgggaggtggaggttgcagtgagccgagattgtgccactgcactccagactgggcaacaagagtgagactctgtctcaaaaaaaaaaaaaaaaaaaagagagagagacagggtttcaccaggttggccaggctggtcttggactcctgacctcaagtgatctgcccgcctcagcctcccaaagtgctgggattactggtgtgggccactgcatctggctcccaccatctctattaaaataagataaaataaacataaaataatgaaccgacaaaataataatacaattcattgtaagtaaaatgctatcctgagttctgtgagtcattctggataattcaaattctctagaattaccacctcagctgactttttttttttttttttgtagagaccaggctggtcttgaattcttgagctcaagtgatccgcttccctcagtctcccaaagtgctggaattacatgtgtgagccactgagcctggcctacaaattctttattatacaacacacagtagatgctcaataaatatttgctaagcagaaacatacactcaaaataccagaaattatcaaggaagttgccagttggtctcttgggttcttcctcccgacaggtatacacacctattgtaaagatgaacacattaggctgtgagaaaccaatactgttaaacattccaatcaggtgacaaactccctgggctctggtttatattaccaagcaacctgatgataacttggcttcctgtgtggcttgtttatagaaagagaatgctacccaggctgacgtgagttgcatttctgagttgatttctcactgtaaattaataaactggcattctggctacatagatcagtctctttgaactctttgtaccttccaccattagtgtgatttctaaggctgcaagccagacactgcccaagacccagcactggactctggtgagttcttccagctgttgccaccccaggaggctctgggagcccctgggaaccatccagcttgctctctgtctctacatttcagggtgtgggtttcagggcattcacaacattcctgcaacagaagagttttgggaacacccccagcaggatgtgggtgatttgaatgtatgtcagagatgtggttgtaactgagaaatcttaagcctagtgaattttattccacttgacttaaataaagagcacgtgaaagaaggggatctgaggacatctatgaacagggccccgagggcatgaacttactagtgtttatatgactagtgtttatctgggcctgtctagtctggagaacctgactctggtgtacccaagctttgcagtggctgtagaggtttgctcttttggagggagaagataattcattcctccaacacctgaatgagggtagattaacccacctccttcagctgcaatttggcaaatttctcttctttgatttaatgctcaacggacaaatttcctttcttcttcttcttcttcttcttcttcttcttcttcttcttcttcttcttcttcttcttcttcttcttcctcttcttctttttttctcctcttcttcttcttcttctcctccttctccttcttctccttcttcttttctcttccttctcctcctccttcctcctcctcctcttcctactcttcttcctcttcctctcctcctcctcttcctcctcctcttccttcttcttcttctttctttttttttcggttttgagacagggtctccgtcacccaggctggagtgcagtggcacgatctcggctcactgcaacctccacctcctaggctcaagcgatcctcccacctcagcttcccatgtggctgggaccaaggcgtgagctaccatgcccggctaatttttgtattttttgtagagacagggtctctccatgttgctcaggctggtcttgaactcctgagctcaagagatcctcctgtctcaggctcccaaagtcctgggattacaagcacgagccaccatgcccggcctcaacaggcaaccttctgattaataattagacctctgtgccggccgtcgtggctgatgcctgtaattccagcactttggaaggccaaggcgggtggatggcttgaggtcgggcgtttgagaccagcctggccaacacggtgaaaccccgtctctgctaaatatacaaaaattagcctggcatggtggcgtatgcctgtaatcccagctacttgggaggctgaggcacgagaatcgcttgaacccgggaggcagaggttacagtgagctgtcatatataatgaaacagttttactaaacttaggaagcagtgacttggtgtctctagaaattgcctaacatacacattccaggatacattctctgtcatctggaatctcctcccttccacaaacccacgctgtcttaagcactattttcctatttgttgttgacctaatctagaaaaaagcggccatcactctttctcccccactcagtccctcagtcccgaaacacccttattctccgcacttgtcaccccaccctctgctgcccccaccgcagcgcgcaaacgcacacgagtttaaagtttaggctgtgatgctatcctcgcccgcagatcacaggacagacattctcggggacaactttgcgaggccatgtgctcgtcccccttaggaaggaagagggagaaatccctgcggctcggttttgttccaatggtctgctcagcgagtgattcccgtttccccaaaggctgcccctcattagcatgaacggggacgcgggtgtggagaaggggttagaggagagaaagcaagcaaaagcccaggctcacttttagagcctgggaaccctgtctgcaaaaatgacagctagagctttctggctcctctgtttaatcgtcggatcatcccccgaagctccggtggagagaaaaagtaagatcggtgtagtgcggagccctgggagcggagcggggatctggggagggggcgcccaggcctcagccgccggccgacaaccgggccaccttccgtgaggccgcacacgctcccacaggcccgcgcctggcgcaagccgagaaccgcgcgtcgccgcgccgcgggcccgcgacggaggaagccccgagacgcgcgcgctcacgggccctacgcttccccgccgcccggccgcgcgcgcgcgccgccgagggccccgccggccctgcccaccccaaccggccgcgcgccgttgtgccggcccccggctcgccgcccgcgccgccgccgcgcctcagcttcagattcggcctcagtcagccgcgcagggacgcggagcccggcgccgagctctgcgcttgcgcttgccgggcgggcatggacgggcgagaggcgttctgcaagcgcgaaatcggtgagcccggccgccgcgccgccgccccgcgagcctttccgagtcccggagaatcctgcacgcgagatcccagggcgcccgacccatgcgggccgtttcgctgttgctaaaaaccaacgcccagggactgggagaggaactggggttcccaaactgttttttggaagcagcgatgaacgggatagtgcatgacgtggacgtgctgggcgcgggcatctggctggtgaccctgctggtggatcgggacgggctgtacaagatgaaccgcctgtacctcactcacccccgacgtcttcttcttccgagtccacatgttagtcctggactcctccagctgcaataaaccgtgtccagagtttaaacctggtattgaaactgagctgaatgacgctgcatatgtactttataccaccgtttgtaacgtgggtgccacagcccgggctgtgggtcgtccagtctttttttgggacggatgggggacagtattgtaacatgattaggatttagacgacaggtattatttccgccactgtgatttaagcaccgtcagccccacccccacgggtgagaacggcagctgttggcacaaagcgggctgtcaataaatagatgttgacaaatggagtgagcgaccaccaaacaccattgccagaagggactgtacagaactgagtttagaaaagctgcttttttgggggagtgtgtggagggttggtagcggggaatacccactcccacatcttttttttttttttttttttttttttagacagagtctcgctctgttgcccaggctggagtgcaatggcgccatctcagctcactgcaacctccgtcccccaggttcaagccattctcctgccctcagcctcccaagtagctgggattacaggctgagccactgcgcccagccccactcccacatctttctaggcatgtgctctgggaaatcctgatacaatgtgataaggacctttgttctgtaatgtgggctggttacgtattgctttcccttccccacaccccgtgctactttttgtatttttagtacagatggggtttcaccatgttggctaggctggtctcaaactcctgacctcaagtaatctgcccgcctcggcctcccaaagtgctaggattaaaggcgtgagccactgcactggcctggttgggttggttatcttctaaaggtcgctagactgtttccaccttgcctgtagactaaatatcagtttcaacttgtgcagcaagatagtagattgcagcttaggtatttcttaaaggccttatattttctgtttcatggcatttaaaagacgctatgaattaatgttctggttattttgtccaggcagcaggtatattgtgatgggccacatctaccataagagagggcagcttcctacagctctgctccaggtcctgagaggccatctctgtccaggggatggactgctgaggagcagcagcagctatgtgaaaaggtttaacccaaaaagggaagggcaaattcaaggtgcaattcatacccaatgcatttgaaacaaccatcctggcatttctggatcacaagagacatcggcaacaagacatgaaaggtctatcttcatgtaatgggtcctcctttagaagagagcccaaagctactctatgaatgacctgcatagttacaactgtaatctcgaaggtgtcactttgttatttacaagatgcttcttaaatgggctgctcctgagctcagtgtcaaggtgattcaactgttgtgccagacagtgatttacacagctcagataactgacctgtctagttaacagatcactgcttcatgtttttaaatattttaatttaatacattctttagtagaaatagtccacaaaacattttcctgaatttaaatacacaacttttatatcatgtatcaaacctgattttatattcaaacctgatttatattcaaaacttatatgtgaagattaaattcttcacataacagtaagcgcactagtcaaaagacatttacctatgaaacgtcatttagatcaaacacaagggtcaaagcccaggacaaggattaaaattttacacttaaaaagtaccaagccgggcgcggtggctcacacctgtaatcccagcactttgagaggccgaggcgggtggatcacctgaggtccggagttcgagaccaggctgaccaacatggaaaaaccctgtctctactaaaaatacaaaaattagccgggtgtggtggcacatgcctgtaatcccagctgagggaggctgaggcaggagaatcacttgaacccaggaggcagaggttgtggtgagccgagatcgcgccagcctgggcaacaagagcaaaactccgtctcaaaaacaaacaaagtgtacaaaagggccagtgtgcggatgggtggattaaaaaaataaattttaaaaaagtgccaaagggcttacttcaggcaaaagtgttcctgatgtaccaaagagtaagatatagtttattttcatgcctccctgctcctaataatgtatgttttgtgctgaactggcagctatcccaatgtgaactgtattctgagtgtatctgatatcatttttctattaagaccaagtataatgtttgcttgtaaagcaataaatcttgctttgaaattagaccttggatgcacctgtttatttttgttttgttttgttttagcctttgagccctaaaggtttgagaaaaagcctttctcaaattcattccccaaaccttggaaccaatattaaccaatgacagctcacaagcaagtgaattctaaacatttttcagttggttttaaaaaggtttaatcactagctaaattaaatattgattttatacctgagtccacaaagacatgagagtattttttcagaagataaggctgtacttcagtttataagaagtacggtgaacagagacaccactaatgcatagatgaagatgactgcctaaagagagacaggggaaggaatttcactggagagagagcagcctatttggcctcacggtgatgcactcaggaaggtcagaatgtgtcctgacgctgtccatggcacccagtagtagcactgtacacataaaggacatccaggacgggacgctagggaatcacaggagccaagaggcaacagcctaacattacaatacctgatactattatttgttccaattatggggcagacaggtaataaagagttgagaggttctgagtgttctatggtaaagcactactgagagatttctagagtattttccaaaaatgagttttgtccaaatttattataaattttactagaattgctttttgggagtcagatgcattattgcatgatagaattatagctaatgaagagcttctgagctagttttctttaagataaaaaaaattaactcaggcataactcaggccagtcaaatcaaagttgaatttttaaatgtcaaaaggctaggccgggagctgtgactcacacctgtaatcccagcactttgggagaccaaggcgggtggatcacaaggtcaggagtttgagaccagcctggccaacatagcgaaactctgtctctactaaaaatacaaaaattagctgggcatggtggtgcatgcctgtaatcccagctattggggggcaggaggatcgcttgaacctagtaggcagaggttgcagtgagccgagatcatgccactgccctccagcctgggcaacagagcgagactctgtctgaaacaacaacaaaaagtatatctatatggctaatttctttagttgaatttggttcaaattggatcaagtggtataatcttctaagaaaagtcttttagtatctcactccaagtatctagaaataccttagaatgtttcaaattattaaaaatacttctcggttggctcttccctccacctcctcaagtacttcattattttatccatggaatatccccattctcacattaagggcaagaaatctgagacctatggtaatagtttcttttttttttttttttttgagaaggagtttcgctcttgttgcctaggctggagtgtaatggcatgatgtcagctcaccgcaacctctccctcctgggttcaagtgattctcctgctctagcctcccaagtagctgggattacaggcatgcgccactttacctagctaatttttttttttttttttttttgtatttttagtagagatggggtttctccatgtttgtcaggctggtttcaaactcccaacctcaggtgatccacctgccttggcctcccaaagtgctgggattatacgtgtgagccaccacgcccagccgtatcatgatagtttcaatcaggaagagtgaaagctgtaataaccatgtaactttgtctaactaagtgtgcagagatctgaaagtccaccaggttggctctttaacataaagaagtagagagtttgcctaaaggaattagcagaaatagggaaataacttttatttgcagatcccaggaaggtagattacaaacaacagcaaatcttagtgtctctaaataacactctaggccatttggaatataaaaaggtaattattttacttcagaaaatatctccaaaagttcactttttttttgagacagagtcttgctgtgtcgctcaggctggagtgcagtggcacaatctcagctcactacaacctctgcctccccagttcaagccatcctcccacctcagcctcctgagtagctgggactacaggtgtgtgccacttgtccagctaaattgttgtatttttagtagaaacagggtttcaccatgttggtcaggcaggtctctaactcctgaccttgtgatctgcccgcttcagcctcccagagtgctgggattataggcgtgagccaccatgcccagccacaattttatttaaacctcctgtagaatttggataggagaataaaagctttaccaataggaaaatacttttcatgaaatggtttcaaggattgtgaacttggcaggtgaagcataacagttattgaaaatacttttagccaaggaaatctactgatgcaaattaaatatatttacaagcccaaggcctgtggtagaaacatcctaagagtatcacaaatgtacagtttactgcctggattattgaaagcaaaatagctgtgttatatagatcttaatagcagaagctttcaaagattactcacagaaaagcagctttcagaactcattatgttctaaaaaatgtatgtttttctttcttttttattttttttgagatgaagtctcactcttgtcccccaggctggagtgcaatggcgtgatcacggctcactgcaacctccgcctcccaggttcaagtgattctcctgcctcagcctccctagtagctgggatttcaggtgcctgccaccatgcctggctaatttttgtacttttagtagagatggggtttcaccatgttggccaggttggtctcaaattcctgacctcaggtgatcccccctgcctcggcctcccaaagtgctggggttacaggcgtgggccaccacacctggccaggaatgtgtgtttttcaaaaattacttttgaaagactaaagccctatagttgataaaactataaaatgtctttatgtatttgtatggtgatagaaactgtaaaacactttataccattaaatacacatgaaattaatatcttcctggtctcaggatttccataaaatttaccctttttaatttggcaatgctaacagctacagaagacatattaccaccaaccaaccgttgcttcattagaaactgcaccaaatccaatgtcaaaaacattactttatttttctagtatgaaatgtcctattacatacaaaagaattgctgtttagaatttgccacaatttgttgaaaacatagcaatctattgcctacaggtaggaaagttcttgctgcaacaaattttaaatgattaagcccatatatatttctatatatatgaataaatagtgcagaaatactgtgacgtgatgagatgcagaataattttataattcattaaaatgtagaattcttgcatcagcacagtgcatacaatatgtaactttttttaaaaagtaaaaggacaaaataatccatatttaagtatttccatcttaatattttaagcaaaaatgttttcatgttttcatattgagtgattagtctctttagtttgtaaacataggtttaagtgacatcttcatgtacaaaaaggaatgggcttcattagataaaattaagccagaataacctgtacacctgagcctgtaataagaaagaattgggaactgtagcaacatctttcttttaagaaaccaaggtctgggaaaggttttgcatagcagggaaacgttgaaaggaaggaaacttttaaaagcaataattagataaattccagaagttgataggacaaagctaatatgagttagaataaaatctagtagaatttttgcaaagctgcataatccagctatggcagattttatagaagctattaccacaatgcagtaatacaatgtgtaagaacattgaaaggaagaacatgcaaaatacatcttcctcattttcttcctactgcttacactacttttccttacatggaagaaacaaacaaaccaacaagcaaaaaacaaacccaatcaacaaataacacagaggatgagatcatctaacaaaaaatgtccttcatacaatataagtagctgtctgtaattggtaatttgcccagtatcacagaatgtacagatgaaggcaatgtgtatcttgtcgcattacctttttcgttagtatgatcaactgatgcgacaggattagcacccctgaagattcttctctgacgtgatgacaattgactgggaatgataaaacgaggggccactgctgtccaggagaattccaggtacaattagattcttttgcctttcatgaccttgcagccctccctccccacagaggcttacagataatcattagcacacattcaaagacacctctgtctgtgggagaaaaactatctccatttattttgtttcacatacatccatagttgaattttaatacaaaaagaaaaattagaatctgacaaatgtttacaaagaagataccttcaaatagattttactcatttcaacctggtgtggagtaattgacaaattgtactgttatattcaagtcaccagagtctgtagtccaggaccacttagcccaacctttatgcaagcttgattttaatctaccatgaacaataaactcattgttgattcgcagttgtgtgtgtgtgcacatgtgtacatagcagctcctttcatagaaagaaaagacatctagaggttgtcttgtacttttacgtacaggaatcattgataagatatggatggattatatgtaaccgtggctggattttataagaaaaaataattagttgacaaatgagggcagcaataaaaaagcatcttttttgcaacaataaataaatacagtcaaaagttttctttgagactctaaaccagcttcttcactgaagagcagacgtggcatttccatggagttatacttgaccccacagtatcattgtttcttgctttctttttcttttttttttttaataaacaaaattttctcgcttctgccacaataataaaaccatttgatcttgacaagataatggtgtcgttgacttttcttttttctttttcttttcttcctttttttgtttttgaaacggagttttgttcttgtcacccaggctggagtgcaatggctcaatctcggctcaatacaacctctgcctcccgggttccagcgattctcctgcctcagcctcccaagtagctgggattacaggcataggccaccatgcacagctaattttgtatttttggtagagacggggtttctccatattggtcaggctggtctcgaactcccgacctcagatgatccgcccgccttggcctcccaaagtgctgggattacaggcgtgagccaccgcacctggcaactttgcttttttcttgtccattggacaaaattggccaataatataattggactgttatgaccaataaaaacaaagtttaggtcaagtcttgtcaggatagcctcactaaaaagatctggctccttaatttaaaatagttcaggcaacaagattcttgctgtgttttatgttaggttaacatgctgaactttaggaagctgtagactgcagtttgttgttgtgagacctacagagtatagaaaaagggaacaattgagcacctttcatttttgaaaatgatgctttatgcggatgccaaagtaaataaatctggaagaagcagccatgttctttcattcacccttggcaagcgaatagaaaagaacgattaagaaatttttaacctataataataaaacttttcactgtacactaagcataatagctcactggaaaaagccaatatttaaaatatgtatgtatatatatttgtctaataaagattacaacattttcaggcaactggacaaatagagacatttacagaagcattaccattgtggtgaaaggtgcgtgtgtgtgtgtatgtgtgtgtttatttacacggatgaggggaatataaagggaaaaattatgctaaaacaaaagaaaaagcaattttaaaatcatatttttctattaaagtccagaaagtctcccagtttcacacagttttattcacaattttttttttttttgagacgaagtctcgcttttgtccccaggctgtagtgcaaaggcgcgatcttggctcactgcaacctctgcctcccagattcaagcgattctcctgcctcagcctcccgagtagctgggattacaggtgcctgccaccacacccggctaatttttgtactttttgtagagacgaggtttcaccatgttggccaggctggtcgcaaactcctgacctcaggtgatccgcccgcctcggcctcccaaagtgctgggattacaagtgtgagccaccaaggctggcctcacaacttttgtcagtaaaccaaattactgtacagttaccaggactaagtcaaaggactttatattgcaatagcagataaatttatattgcaatagcagataaatacagtattccaatagtttacaatttttaaatacattgtttcacgtggctgctagaataaattttttaccactatacatcgttaacattaaaaaattatattagctaacctgactttttggggggcaattttggattacgtaatcacaaggtacaataaaacagtgaccccaacatccagttctgattccagttaaaaatttagactaaagatatcacaatccgtaagaaaagaaagaatatggatggtataaatgatgaattataacaaagtgcagtaatgaaaacaatgtgcaaacaatgctggagatcataaattacaatgggaaaatatggcaaaggaaattctggaaacccataataaaatcaagtttcaataactggctagttatgtttcattctaccttaaatctggaaagcaatagaaattccctaaaaatgcaacagcaagttgtctttatacaattctttgcattgtaatttttttctttttttctttttttttttttttttgatttgtttgttttgagacagggtctcactctgtagcccagtctggagtgcagtggcacaatcatggctcactgcagcctcaacctccagggctcaggtgatcctcctacctcagcctcctgggtagctgggactacaggcacgtgccaccatgctcagctaattttttgtattttttgtagagatggggtttccccatgttgcccaggctggtctcaaactcctgggctcaagtgagctgcctgccttggcttctcaaagtgttgagatcacaggtgtgagccactgcacacagcctaatttgtttatttaagcagaattgagcaaacgtctccattcagctcccatgtgctttattgaaaattatgtcaacttcagtatattaaaaagctacataaaataaccaggtggcaagaagacatcctaagtggcccctacactatgcgggcc

SEQ ID NO: 30 - DNA, 201458 bp, Homo sapiens
aatccattctgaattggccaaaatatccaacactccatcacagaaaagtatttgcagttacctgataatgccaggctctttcaagcctatgctgcattacacattactccctacaccatgcttcagcaagtccataagactcagaaaaaagtccatccttccctaggaaactacctttactgactccctccagcactcccattttatgcttgttggaagaacaagaagcactcaagaaaagatagatacctggttctacttagtctttcagacacaaagtgcagtctggaacaatgacaattagcttttactaactttcattatctatcaaacattgttaaaagcaaattataaattttaaattaactttgtaagaaggctagaaatcaggtagtaggaggagagtgtgactcctccaatttggttcttgtttttaaaaattgttttggctactggccaggtgcagtggctcacgcctgtaatcccagcactttgggaggccgaggcaggcggatcacttgaggtcaggagttcaagactagcctggccaacatggtgaaacccccgtctccactaaaaatacaaaaactagctgggtgtggtggcacacgcctgtaatcccagctactcgggaggctgaggcagaagaatcacttgaacccaggaggtggaggttgcagtgagcccagatcacaccacagaactccagcccgagtgacagggagagacttcatctcaaaaaaaaaaaaaaaaaaaattgttttggctcttgaaaatacttaacatttccatacatacttgaaaatcaatgttcaattgttaccaaaaacaacacaacataaaccaaaaaatcttgctgggatttttcactgggtttgcattgaatcattgtgtctaacattgactcttctaacacataaatacagcatacatctccgttcacttatgtaatctttttcagaagttttatggtttcagcaataaagtcattaacgtcttttgttagatttattcctaagtattttatgtttcttgatactaccgcaaatggaactgtttctccgggttatttttcagttgtttgctctaataaataaaaatagaattgacttttatatattgaccccgtacctggagaccttggctaaatctctaattctcacaggtttagggaattccatggggtttctaagtatcatatcttcaaatacaagcagttttgccctaccttttccaatttccatgcctttaattgcttttttcttgcaatattgcattagccaagacagagtacaatgtttttgtttgtttgaggcagggtctcaccccgtcgcccaggctcaagtacagtagcatgatctcagctcagtgcaacctccaccacctgggctcaagcaattctcccacctcagcttccagagtagtgaggactacaggtgcacgcccccacaccaggctcatttttgtatttttttgtagagatggggtttcgtcaggttgctggagctggtcttgaactctgaggctcaagcgacccgcccaccttggcctcccagagtgctgggattacaggcatgagccactgtgcccagcttacaatatttttaggatatatttttttcctaattgtagaccaacaaaacaagcactttcaccaagtagtgtgatgttaggcgttaggtttttttcctaatttttaaacagcatcacagctcaggaataaggtcttcacctttgattttcacgatttttactacaatgttgtgattctcatggttattattcttgaagtttcatgatttttttattttatttttgagacggagtctcactctgttgcccaggctgcagtgcagtgccatgatctcggctcactgcaacctctgtctcctgagttcaagcgattctcctgcttcagcctcccgagtagctgggattacaggtgtctgccaccacgcttggataatttttgtatttttagtagagatagggtttcaccatgttggccagactggtctcaaacttctgacctcaggtgatccacccacctcggcctcccaaagtactgggattacaggcatgagccaccgtgctcggcctaaagtttcatacatttgtaaactgactgtttaaattcaaaaatccagtcattaagttcctcaatttttttccatctttttttttctttttcctcatgactaagaatcatattctcatgtttattcatatgtatggtaattttctattatatacagacaatgtatgcaatacattatagagactctgaatttagttagcttttcctaaagagtgttgatttttgttctagcaggcatactactactacctggttaccttcattttgtggagctagttttgtttttataaaagcatagtggagtctattttggttccctccttaatcctatggtgaatgccttcgtcctgggaaacattctttaactctttaagtgtgagcctttattggtttcaatcaaagccctcaggtttttgccaagtctagttggaattcgaactccaaattctgccttccctgcattaggcaatgatgatcttctctgctcagctctttcagccttccaattactgctttccactatgccctataaaatcttccctaaacatgtgcaggtcaggggtgagcacaaagatctgaaaggggctcaaatagattgtgggcctatgcccctccccatctcccatagctccctctttgccactattcccctccttcaatttctacctaacttggcagccctgaactccatcctctgataatatacaaacaagcccatgaagcagtgactattgaattctagaagctctggggcacatggactgagaatgctctcatctcttcctggcaatactttctgtctgaaattttgctgacattgttgagtaatttacctagtaatatgcacaggttccaagcttgcccttctttgctcattactttttcttaagcaggggaaagcaagcttctatttgaagagagagaatgagaaggtggggaagataagaggcatgtttcaatacactagagaacaactctcaaccgctttttacatgctctctttccaagggcacaccctctttgttcaaaaggagtcttaaatttcacagaagcatttatctgtacacacgacttatcggcagctaccaagctagaggcccgttaagttttctctccctcagctagccttacacctttaaaactgcctttgagtcagaagtcagaatgaagaggttaaaataaaaaaagaggcatttttctaggcattcctccttaggtcttccctttctctaacccactactctgtggtataaaaacagtacccacttccctaacccagaaaatattccttgatttgctccatgactcaaaaaaggttcacccatgaattcagtctccagttcttttgctcataggttgggtccttttagaacaacttagttcaataatatctgtactgtattcaagacccaagcagatatatactggttctgtcaataaacaatcatcctgtttggaaataaagcaaaaagactatgtatccttgcagtgtaccactgggacattacctaacaagcccacccaggaaacatctgactctccataaattatttaactttgttttacctactatctataattgattagggcccagaagtcttactggatgtttattttagaacgctgacaagttaaagttggtttgcatcttgttgaaaacaatgtccaaagttacagctttattgttctataggatattaataacttttgtatgctactgagtaatcatattcctgcattcttcctttttatctggtattaaaatactgttaacagtttggccaccatcatgattcccttgttattcagtaaatcactatatatttaggaattatgtctaggctggtgcagtggttcacacctgtaatcccagcagttttggaggccaaggccagcggattgcttgtgctgaggagtttgagaccagcctgggcaacttggtaaaaccccatctctacaaacaatacaaaaattagccagacatggtggcacatgcctgtagtcccagctacttgggaagctgaggtgggaggatcacttgaacctgagaggtagaggctgcagtgagccaaggtcgcaccactgcactccagcctgggtgacagaataagaccctgtctaaaaagatggaaagaaagagagaaaaagaagagagaggggagagagagacagagagagagagaaagaaaaagaaaagaattatatctaatgttttgaaactatattttgacaattctaaagacgctgatttttttgttaattccagctgagtttcagaaatgagaataaaaaaattaaacataacagaaaatacctctgacattattatttttaaactacaagtcttcaaatatatttttgggtaataaacaagcacagtccaggagtttgaggctgaagtgagctatgattgtgcgattacactccagcctgggtgacagagcaagagcctgtcttaaaaaaaaaaaaaaaaaaaaaaaaggaataaatacacctacctccatttggggaaaaaattaacaaaatggaaaacaggctggttacatgtgggtatgaaaacctacagttgccctctgtcccgggcaacctaatttttttttttaagcaaaactgagaaaagtcactttcctaaaatttaaaacaaaacaaaacaaaaaaacctggggaacaaacaagcaaagttaaatactgccttcttatacagaaaaactttgcctggcaattgacatacgcacagctttgcaaatatttggcattttaaaaatttaagtcaatagcttttaagaaacatatgctctgcgcccattctactaataataaacaatggaaatgtattgtccctgctccccccaccccaccccccaacccctgtcttctcttaatactttctgaacgcttttcagaaagcatggatatattcataaagggtagataattcacgaaaacagggaaggggtaatctctccttgacaaaatagtgacagtgtatacttagttgttttcattatttattttactcaatccaaaaagcattctattgcacaatgttgaaactagtatggccaacacaaagggaaagatggtcttgaccttcaagaatcttacaatttaatacacacacaggaatcttacaatttaacacacaagtaaatgaatgaagggtagggaaaggaccaagctcctaaagagtgtgtgtgtacaagtgaatctgtataaactgtctcacaatcactgtggattttttaagacaatgaggattagtaacacaatggaggactgttatgccctgtccttcagaagtgctgaggtaagagaaaacatgactacagggagattactcaaaaaagtttggaatccctaaattctatatacaaatatataagtatctacatagaacttactcccctatcacatatgcctcatgtttcatgtttcctgtacccataccaccaatgtatctatgtttcctttctcacttaacaatttttaccctgattagaccattcactaaaagtttcattaataacttaaaaaagatctgtaaacagcatgcaatgaacttatattatagacttaaatagtggcaaaacttggcattctgctctttaatttattcaaaactactttccagttaagaactatcaatcttctagtgtcttcacatttatctctagcaacagtggctggctttcaaaattaggtgagagatctttccaagatctaaacatctccaatatctgcctcagagaaaatttagtttccaccacatcatgcgttcctgctaacaatgattaaaataaataaaagaactataaggttggtttatttgcggatacaagaacagcttgcttaactcaccatttaaaaagccatcacttcacactagctttattatctgaagcataatcaaaataataaactacggttgtgggactttggaatttctaattaagttatggagacttaaatcaagaaatatgaatattcataaaacccagtaaccttttaggcaaagtaaaaaagtgaaaagaacaagtgctcttggaattcagaaagaaaattaactatggtattgagagaaaccaggaaagagaaggaatcacagtagagctaggatacagaaggaaacagaaaatgacagtttaatgctcattatagaataacagtgaatcacccacagagaccattttcagtgttcttgtgaatttaacctctagtctaaccttttaatgaaaaggctataatatattagagtggcccagaaaggtgaccttatgtctcaggtgtcagagccacacccaggtctcctgattcccaatgatactccctaaagccttacttgctctggctgtagtgttttgagaattggagctgcttttaatcctatggtcagctacacagctgcaggatgggccctagattccctattcaggaattcagatcttaaaacaccaaaagtgataaaagtagatacagttccccttcttcagccaatgcaaggatcctagttacagagaaaaaacggtgtgccaagacaacacccttaattctcacgcatttccccctttctatcttttatacttaccaatttatcagtcccatgatctgtcttcacctcagaactaagtggaagaaataagtctgttgtatgctctgggggaggtacctccccaagaactatcaacccctgcaggatagagaggagaaaaatagcataagtgagcagtataaacttcaaatttaatttaggagttaagtctcaaaaggactgttggtgtactagaggccccctcttcctcaccctatggttcagaaacaaactacagcagcagcagctttgttttcccaaagagctatttcaacaagcagcagacccaggctcccctctctgccacttgactgctctgacctacatggctcatcagccatttagcatctttattcatatctttcagatatgaaatctttaccagattatggcatttataccatattactagactccactagattaacagcagcaatgcagtttttgtagccaacaaatgcagtttatgacttactaagctgaaaatgctactattcttaatcatgtactccaccaactatacctgcacaaacaaaactgaatgaaacaaatgtggaacagtcccctacaatttatgagaaaccaagagcttcttaaaagctggcccaaaggaacctgcttttttcataagcataaatattacttcagattaagttcctgcttgacaatttcaaattcagacctttggaaattcattccaggaaacaatttacataaaaagaaattaaaaatgaacccacaagtcctccccattgtacatataatgagccaggatgggtaaaggcagaaggtatcttattattaaaaaaacaaaatactacatatgaatcccaccatgtataccagaagaggtgacaaaaataaggctatgacactatataaccgaaagactgggatgcaagtgatcagggttcccaatctctttctctggtctaaaaaatagagatctaactagattaagaagctcttaatggaaatttattatcagaatcacctggggaaccttatcaaactatactggcttaggtccaacatctactcagtacctctgggggtggggccaggtagtctacctttttatgggggaagggaggcaggacatggtgggtacatggaggtgggtgtctctctcctcccccaccccgccaaccccactatgttaccgaggctgatctcaaactcctgggctccagcaatcctcccacctcagcctctggagtagctgggatgacaggtgcctaccaccatgcccagaggtggatattctactattctttaaaagctcccctggtaagtcctaaacttgtaaagttgaaaaacactagacttgattagtttgggctcaaagaacatcctaaagtatagatttgggggactagggattgtgactattagtcttagctctctaggccatacgacagactcttatgagccactaaaccagatgatccatccctggggtccttgtaactaaaaaaccaatatgaaatacaagctgcagaaaaggggaaaacattaagaaagaaaaatggaattttatttcagtttttaaaaaagaagtatgtatctctttttctcttgaagcaaaagaagcactgcctccctattctggaatatgactacacttagcctgtatcaaaaatgaattggagggtcccggaatggcggctcacacctgtaatcccagcactttgggaagctgaggcgggtggatcacctgaggtcgtcaggagttcaagatcagcctggccaacatggtgaaaccccatctctactaaaaatacaaaaattgcccaggcgtcgtggcacatgcccatagtcccagctactcggaaggctgaagaaggagaatcgcttgaactcaggaggcagaggttgcaatgagccaagatcacaccattgcacaccagcctgggcgacagaccaaggctctatctccaacaacaacaacaacaacaacaaaaatgaattggaggctgggtgtggtagatcacacctgtaatcctagcacttggggaggttgaggttaggagtgcgagaccagcctggccgacacagtgaaacaacgtctccagtaaaaatacaaaaaatagctgggcgtggtggtgagcccctgtaatcccagctacttgggaggctgaggcaggagaatcgcttgaacctgggaggtgtaggttgcagtgagccaagactgtgccattgcactccagtctgggcaacgagagcgaaactccacctcaaaattttaaaaattaaaaaaaaaaaaaaaaaaaaaaaaaagaattggagtctcctcagaaacaagagaaaggccattaactagtaagcaagaaacattaaccctagcctttaaaatgaggtttctctggttaaagaacttctgcttcaaaatattttcttccctaaatcaaaagcataaaatataccttacaaactttatcacatccaaataaaaactatttgcaaaagacagttatcttgtacaccactgccttctcaaaacgttgtattcaacagatattccctacttaagggcccaaactgtcttcctgcttcctgtacaaagcatgccaaaaatcattttattattcaaattttcccataaccggttcctaagaacttttttaaagatcaatttccaactactttccccaaatatttgttagtgttataccaatctcatcatctcctagacaaatgtttcaatgaatgtgaagctgttgctgctgctggaggtaagggttattagtcagtagaaggttaaaaaaaactgaattaaaggttaacacatgagctgttcatctttatttatactcatttttatattttatcagtccaaattgccgttcgtccttccaaagagattttcaacaagtcccacctccttccaagaaaatgtcccgggttaatgagttcctacttgctttatccacactgccagacctcctaaagcacggtgattgtatcttactttctgtgtatttaaatctcatttccagagcattcataatcttatgccacattatttatttcacttattattgcctcagtttcttgtttgttgagacagggtcaagctctgtcacctgtgctggagtgcagtggtgtggtcacgaatcactgtaacctccccctcccgggctcaagtgatcctcccacctcaaccccataaatagctgggataacaggtgcatgccaccacatccagctaatttttgtatttttttggtagagatggggtttcaccaagttgctcaggctggtctcgaactcttggactcaagtaatgcacttgcctcaaactcccaaagtgctgggataacaggtgcaagccaccacacccagctaattgttctattttttggtagagatggactttcaccatgttgccaaggctcgtctcaaactcctagactcaagcaatccacctgcctcggcctctcaaagtgctgggattacatgtgcaagccgctgcacccagcctttaattgttaactaatgttagtttattgaagatgtggacaaaatacaaatatatttaaatgacccatgtcccttagcagagtcatacaccaagaaaataaatgcatagcaaatatttgttgagttgtataatttttttcctaacaggaaaatattaactttataataattatagccagaagataaataaatctaacaattagatataaaattactccttcaatttttctttttcagttatatgaaagtaaggacgcagtcagtattttccaaagggaagaatttttccttaaactacagaataatttctaaatacaaccctcagatagattatgaagacatctcctaagagagtataataaaacttggtagggaccatctattcatcgacataattttatagacccacagaggatgtaggtcaaagcttatgtctctacaggccaatacatggcagaactggggcaaaagtctgcatctaactaatatttcattcctcttttgttcagttaattcaatcatttatccgctcatcagcatttgttaggtactaaggatacaagaaaaaatgagagacctatccctctcccctaacccatccttcaaagtgcttattacgttctaatactgcggcaaagaaaaacaatgtaaataggtaaatgttatgtactacattagaaggtattaaatgctagagagaacaaaatataggatagtgaggggattaagaagtggaaatggtggggttggtcgtgacggctcatgcctgtaattccagcactttgggaagccaatggaggaggactgcttgaggccaggagttcaggaccagcctgggcgacgtggcaaaaccctgtctccacaaaaacaataataataaaaattagcctggtgtaatatcacacctgtagttccagatattcaggaggatcacttaagcccaggagagagagagagatacaagtgggagggggtactacaggcgcataccaccacgcctggctagttttttgtatttttagtagagaaggggtttcaccatgttgccaaggctggttgcaaactcttggggccaagagatctacccgccctggcctcccaaagtgccgggttgcaggcatgagccactgtgcccctgcttgaatgtttatttgaagacagaatcaaccagctatgccaatgtgcttacaagataggagggaaaagagtcagagacactgccaaggtttctagcttccacaaccagaagaatggaactcttcttcatttgttcagaggacatttgaatacacattagttttaattaaacctatttttgaaaatatgtgctcaagtgttacactgaagcaaccaacaatcatccatacactgtccattgcccccaagatatgtaagttcactatggcattcaaaaccaaacactggatcctctaatttaatactgtacctcacaccaaaaaggatgaaaacagctaaaaagaggctgagcaaataaaaagcatccaagtaggtaagagtcattcatgcaggtagcatctattgagtggctaccacgtgcaaggtagtgtgaaaacacagtaataaaataaaaacagattctaccataaggagcttatgttcatctagccttgaacagacaaagagacaaagtattatgacagtactataacagaagttgagagaaggtgatgtcagagcagaaaagagcctaactgaagagactgatgaaagtgaggctttacagaggaggtctacataattacttaacattccccaaaatatatttaatatattttgagctatacttattcattaactatacacttaatgactttgcccttttctgtatacaatgtttcatatgccacaataacacttatttcggataaagtttactcatgtttaataaccatgaaaagaaaggttagcattagctgagaaaacttcataatgttctactccacacctgtcatgctaccccaacatgggcttccctaacattccaggtttaaactgggtcagtgttgaatagctgtgccattagcctggtggcaataaacttagggctgctgtactatgaaatagcaaccggtagaagccgaagaaaaaggtcaagagtctccttttccttcgccatgtcccgagtcagagccaggatcatgcttaggctgcacaggcctagaaaactccaagagtgaagcaagcttctgctttacacaaggaccaaaggaactggaatgggtcacagttacatgcagccttaatacctcctaagtgactcctctgtggatgaaccctctctcaactgtatttgcaatacagctaacaggcaatttcacatacttccttacatcactctatcaggtcaatcttccctatgcatctcaagacaaaccagtgaccccactgcagaccagttccacaagaatcaccctgggctacctggaaaagataagttgtctaaagtgctttaaaaaaccctattaagatgagaacttcaacagctttatgaaaattttgaagagaaaggtgttataagcttctgcagttcccattcaactccttccctattcaaaagtttcaatgctcttccacctcccatcctcaataacatttccatcctcagctacagctgtgtaatctcaaagagtagtcagaagaggagattttaaaaaacaacgtaagagtcaagccagtgcttctgggaggccaaggcaaggaggatcacttgaggtcaagagtttgagaccagcctggacaacacagcgagaccccatcctttaaaataaaaaaaaccctttaacaattagctaagcatggtgggacttgcctatggtcccagctacttgtacttgcaaggctaaggtaggaggatagcttgagcccaggagtttcaggttacaaagaactatgatctggccattgcacctcagcctgggcaacagagcaagaccctgcctcttaaaaactgcttagtccctattctttcccctcatttaccaggtgtgaaatttcaacaaacatgtttcagtgaaatgatgaaaaggacacaacagcaaagtatgttagaaaaaaaatgctttggaatcagataaaaagtcctgagtttaaatttagctctgccttttacaagcctctgaagatttattctgatcattaaacgaacatacatgagtaaacctttaattagtatacactcaaggtacgtatattgttttcgtttctccttctaaagcatggaagagtttctttttaaaaaacaagctgacaaactatgaaaattaaaagagtacaacagcatgcagaagtagtacagaggagttcctagaagttatattctttctccagagagcaatattattcccaaaagggactctactcacttcacagcttggaaggtaatacctaccttctgacagaacagaaactggtgtctggatcctagaatcacctagcagtagtcacaaatactttttttttttttggtaatacgccacttaaataaaattaatgttaataagcaacaaagtaaatccttaaaaagaaaagccccaccatccctccaatctcccacccgaagacaaattataactcaacagcctatcaccaagattcagcctatcacctaggttcatctcaaaaaaaaaaaaaagacctgtgcaacccaggaagtgctgggaaatcttggtgcagcatggaaaatatgaacaccaacccacttaaccaaaacacataggaaaaactttcttccatttcagtaactaaaaaaaaaacccaagcacttaaagtgattactaacttgagcaatagctctgcactcacttggatgtgtaaccatgaacaaactacttgactgctctgatcttccattgtttatcttgaaaatcgtgaatgagagtaaaatgcttagcacagtgcctgacatatcacaagtgctcaaaaacttctattaattatagtgttacataaagactaaatgcatgtgaatatatcattgggggaaaattccatggcttgttagagcaagttgaatattgtctcttccaaatttatgttcacccagaacctgtgactatgaccttgtttagaaaaagggtctttgcagatgtaatcaagttatgaagagccatttagtgtgggctctaaattcaatatgactggtgtcctcctgacatggaaatctacacagatgcaaagagaaagatggtcatatgaagatggaggcagcaactgcagtgatgtagctacaggccaagaacaccaaggactagcacaatatcagaagctggaaaaagacaaggaaggattcttccctagagcctccatagagaccatggcccttttgacaccataatttcagacttctggcctccagaacggtgagagaacacatttctgattttttaagccatcccatttgtgatagtttgttatgacagtctaggaaactaatccatttgttgaaaaagaaatgtataaatacgacacgtaaagctgtgaattttcttgatgcattacttattggaactatcaacctagttttattcttcctatcggaactctgagaagtaaaagattatctatgatgttgtattttacagaccaagaatctgaagctcagaaatgttaagtgacttttcttctcaaggttcatgtaagcagctggtagcaaagccacgattagaaacaaaaatttaccaagtccaagtatggtgcttaatacaatacgctttgaatgatgaaactcttggataagcaacatacattcatgtgccaaatagcattatggtcaatgacagaccacatatacaatgatggtcttataagattttaatacagctgaagaatacctgttttagcacaaagcactactcctgtgtttgtggtgatgctggtgtaaagaaacctacagtgctgctattagaagtataccacatacaattatgtacactaagaatataatagctgataataaaagctatgttactgttacacttatttcttatgataataaaaagtgttatgtatttactatactatacttttaatcgttattttagagagtacttctactcattaaaagaagtgaactgtgaaacagcctccagcaggtccttctgttggcactgtcacaggcaatgaaagctccgtgtgtgttgttggccctgaaaacctaacagtgtaacaagatgtgaaggtggaagacagtaataccgacaaacctgaccccatgtgggcctacgttcatgtgtgtgtttgtgtcttagtttttagcaaaacagtttaaaaaataaaactttcattttaaaatggaaagttttaaagatagaaaaaagcttgtagaataaggtgtgaagaaaatatttttgtacaattacaatgtatttgtgttttaggctaagtgttattacaaaagagtcaaaaagttttaaaaacttaaaagtttataaagcaaaaagttatagtaagctaaggttaatttattattgaaaaaaatatttaaaataaatgtagtgtagcctcggtgtacagtatttataaagtttatagtagtgtacagtcatgtcccaggcttttcaatttcagttacccttcacccaccgactcacccagagcaacttccagtcctgcaagctccattcatggtaagtgccctatacaggtgtaccatttttatcttttctactacatttttactgtattttttctatgtttaggtatgtttaaatacataaatctttaccactaattgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatatgagacagagactcgctctgctttgcccaggctggagtgcagtgtcgcgatctcagctcactgcaccctgtctcccaggttcaagtgattctcctgtctcagcctcccgagtagctgggattacaggcacccgccaccacacctggctaatttttttgtatttttcatagagacaggggtttcaccatgttggccaggctagtctcgaactcctcacctcaggtgacccacccaccttggactcccatgcctcggcctcccaaagtgctgagattacaggcgtgagccactgcgcacggccctcagcttgaatttaagtgcactttatgatgttcacgcaccaatgaaatcacctaacaacacatttctcagtttcccttttgttaagcaatgtgtgatggtatatacaaaactccagattattttccagatatttagaaatacttttcagatattttgatattttgaaagtttctgaaaattgctctgtcattacttctgagtgatgagctgaagaataaagcatgaaccaaatgaggtgagtatcttcttatacacagctagtgagactataaactgacactgccaaaatacttctctgaagaatgcattaagaacataaaagagcattcatacctttgactgagataaagatatttatcatggcatatttaatttaaataacaaatgtaacttaaatagtcaacaaagaaagccaatagcatgcagccattaaaaatgttttccaaaaaccaactgggaaatattcagggcacatacgtaacatgactgtatttgaacaaattacttatgtgctaggaaaatgtaccataatgttggtagcgagataattttgagctgttgggttgttttttttttttttggggggggggggagggtgggtgtcttttatacttctatgtcatttcagtttcctgagaattgatacacagtatttcatcaattctaagaggtactctccccacatgtcaacaacttttaaatcaagatgcattttacaatttctgttatgccctggtttaactgaaataatttctttgtcgtacttaaaacaatggtacatcttacaatcaatagcatcttaagttctatgaaatgtagcagttttataacaaggaactaagatgatataacatatacacatatataaacccacatatatatttatgaatgtatataaaaagatgaagcagcacttatgactactattatactaatctcagttgttactaagagactctagttctcaaatatagaaaatcccacttaactactggctataaaaacctagaaacagacactgaagaggtgtctctgatagagaaagactgtgtttttctcctcagtacaggcatatccagtcacctcctagttattcttagtcatcattccagttcaagttctacaaatctcactttaaaatttcctttgtgaagacttgggaaagcaaaatatgcaccaaatctagaatgtttattagttttgttccagctaatttttaaataagtaaatcaggatttaatttgtatgctaccctaagggaacaaactagtaagaataaaaaagtgagccctctggactgtgtcctcaattaaagtatgctctattgaacttttagggggagggggaatatatatatatatatgtatctccaatctggaaagaagctataagtccgcagtgacatttttagaataaaagtttaaatgattagatagcccacagaactttcacttcaaaccctgatcattctgttcattttatcagttgatcaaccttcaacttttggcctactaatttaatggatactgttcacaggaaagccattttcttaaggctttgactagtactaaggtcaaaaaggcattttgacccttatttttagtagcaatagactttttctagacatgggtctacataaagatagagctcagccacaccaagctaatataaaaaatactttgcaagaatgtaagcttcatgaaggtaggatttttgagaacactgctgagacacagtaagcacttaaaataatggtacatcttaccatcagtagcatcttaagttctatgaaatgtggcagttttataacagggaactaacaaatataaatctaacaaatatgacagttaacatcaatggcttgcttgcattattcagtctgttttccttgtttcctgttagctcagatacccacacagttttgttctaaatacacgttcagttaaacattatattctaatagtgttttcctttttatgagacaggcctttcttagttgtccaggctggagtgtggtggcacaatcttggctcactgcaacctccacttcgtgggctcaagcgatactcccacttcagcctcctaagtagctgggactacaggcacatgctatcatgctcaactaatttttgtaatttttgtaaagacaaggtctcactatgttgcccaggctggtctcgaactcctgagctcaaatgatcctcctgccttggcctcccaaagtgctgggatcacaagagtgagccaccacgcgcagccacatcaggttcttaaattaaaccactatatcaggtcattaaaccatttactttgcaatagttaagaagagggttatgggggttacgaggtgggaggggatgtgagaaaagcgatattgatagttttcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaagacaggtggtaaacgattcttcactccaactagaaaggaaaaaatgacaacatactatgaaaaaagctatgaggcaggaaaaagcacacgtcaaggcatggagatacggatatagactaggtaattttgcaaccacataagtgaaagaaaatttgctatccaatcttcctattctctactcccaagagcctagtgcttttgtatagttttcagctcagtaaagtgcctccagatttataaaagctcaatgacaataacaaggtatctttattacaaaatagttgttaaaagtttgattcgaaaaattttaaggaaacctttcaggtaactgaaagtggagggtaggggcgcgactcatgaaggagttttttaaccaaagaaatgatatgatacatttttaaatgaccacttcagttgcaatataaaataacagattttggaggaaaatgtcaatacaaggatatcaattatcaattattaggttactatattggttcaaggagagatgatggtggctgtggagatgagtgaaatcaacagatccaagatatattttagagagtattgtagaagactaggaatgggagtgaccagacaggaatgaagacttctagacttactgcacactgtcatgaggaaggatggggatggaagggtacagtggaataagctgggttttagcagaaggaatcaagagccccattacaaacacattaaatggcctggcgtggtggctcacgcctgtactcccagcactttgggaggctgaggcaggcggatcacctgaggtcaggagtttgagaccagcctgaccaacattgagaaaccttgtctctactaaaaatacaaaactagctgagcgtggtggcaggtgcctgtaatcccagctactggggaggctgaggtgggagaatcgcttggaccctggaggtggaagttgcagtgagctgaggtcgcgccactgcactacagcctgggcaacaagaacaaaactccatctcaaaaaataaaaaataaataaaaataaacacattaaacgtttataatgtatttacaagactaacaatcagataaagtctgaacttcagaaaggagatagagctgacctgaaaatataaattacgaactattgttatatgaatgttacttaaaagacgaggaggccaggtgtggtggctcatgcctgtaatcccagcactttgggaggccgaggcaggtggatcacttgaggtcaggagttcaagaccagcctggccaacatggcgaaaccccacctctaccaaaaaaaaaatacaaaaattaatcgagcacggtggcatgcacctgtcagcccagctactcaggaggctgaggcaggagaatcacttcaatctggaaggcggaagctgcagtgagctaaggtggtgccactgcactccagcctgggcaacagagtgagactcggtctccaaaaaaaaaagggcagaagatggggcggaagaatagagataggaaagaggaggatgttgagaactaaaccctgaggtacttttagtattcaaagtgtaggggggtctggaaatcttgtagagaccagtaggggttggagtatgacatcttccaataatgaattctcgttgctgtccccttatgggtctgggtctacctgatagtctcttctggaagtcggtatcacttgtgcttaatttctactcttttgtgccctctatacagcctctactacaaatcttttttgaagaagcacagggagaaataacttggggaaaaaaaaaagcctatcttttagaaatagattctgaaatatttacagatgaaataatatgttgtacagaattggcttcaaaatagtccaagtaaggggtggtctagataaaaaaaaaaagaacagctctgagtagatgcctgttacagttgggcaatgcacacatgggaaggttcactgcactggtctctctgaatatttcacaataaaacataaaacatagtatggaaggttggcaaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcgtagcccgggcggattcagccccacaaaatgggcgcagtttgcaaacagccccccggcctgggcgccgagggccagcggcgggcgggggcgcgcgacggcggctccggcccgggcccgccgctctcctccccccgacgcccggagccgccctgactttccgggcgggggggcgaggcagagggggaggggaaggcggcggcggggagcggctgctttttcttctctttcgggccctttcccggccttgctccgcaccgacggggcccgagcacggctggagaccgcagcccggccgggagggcgggcgggcgggggcagagagtgaaaccgcccccccgccccgcacaaacaagcaccgccgtctgcagcccgaacccgcacccaggccgccacccccggccgcctctttccagccggggagcgcgcttcagccgccccccgcgccgccgcggcgagacgagtcggcttcgctacggtgctcggttctcccgccggctcggcgagcggtggcggcggtggcggcggcactgggaaaatggcggccgagctccttttccctccccccctttaatctgaagcggagggagaatggagcgagcgagcaagcgggcgagcgccggggacacggggaggagggacagcagcgcctccgccggctgcggctgcggcggcgaagggccgctccaccccggcgcgccgccagggggcgcccgccgcgccgcccccgcgggccgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggtgagtctaacctgaggcactgacgccgtcacatgccctccgtgctggggccggcggtgcggctcgccagttgaggggcagggcgggccggcgccgcggagcgagaggacgtgagcgaggaactgtttgcactgtgtagtaaagagggtaaggccgtcggcaccacactattccaaggctaaccctgcagaaagctccctgaccagtgaagcggcttccgccgcccgccctttgtccctagcagccagcctccgtatactgcagcacggctgggcactagccccagcaccgcgctccgcagccaccagagttgggcggggtggggagggtgcacgtagtcactgcgcaggccccagccagggcccgcgccgggccagcccgggaagggacagccgggagccagaggggaagtgatggccccgccggcgccgggcccgctgggaactgtagttttcgtgaagaaacacgcgtcttgttttgggtgtcatggcttggcagatccgccaaaacaggcaaatggcattacacaatgagtatttatgcttcctgccgccaccaaaaggaagttcactgccatgctaaaagtttaacaaagaactccataaagaaacacaagtctcacaacaaaaagccaacttcccacctcgttaccagagttggtttaaagtggtggcaccttatcatttctcatgaccagtttatcagtacagaactttatattgtccccaaaataggacctttaaaataatggaacctttcctagacttaaagaattcataaacataatgtaatacaaagtgtcacacaaagtgtaattctaccaccctttaaagttgccaaaagatgagtggagtatcttgagatttaaaagactaatctaggattcatcaaaactggcttaaatgactgaagaaaaaatcgttcaaatcattaaatcatcaaattcggcagataagaagggtatgtatgctctactaccaaaaaggaagacgcaaaatgcttcacacttttttgtggcttaccagaaccaatatccggcattatacgtcacttctgcttatcaaaaaacaccctcacagtcgttacagaacggttttagtcttcccacaaagttacactaactcacctgcccctgcaacatctgcacctaggtttctgcgaatttccatttgtactcctaaaatcacactctcaagcatagtcatagttctcaaataccaaaggcaggcagtttggagtcatagggtcaaattacacaaagaataaactaatatttgtatacacatccaaaagaggtctttagtcttggatttttaatttacaaccctggggaaaaactttgacttttttattgtacacacatacacacataaatagtaattccacaaaatacagtagaagggtattggaccaacagatggcgaactagagccccaatctgaggctcctgaaatctaaattagcagaatgaaaaataccaaataaggcaaagccctttgcagcgtatacttaaatattaaattcagacacaccataacaaaataatcttactgctgctccaaatttttaagactgaactgtcagatttaattaggcaaccaaataagcaagattatatgaaatatatttttctaatggattaggagaaaactggaaaatgctcatttttaaaaccatgtatttgggggaactataaattccagtttcccctttctctcattgcttagtgcaagagtcaagagttcacagggtttatggcacttaaatcagtcaacctgttgtatattcttatctaaaatcagacatctttcttattaggcatccacttgtacttttatttttttgacagggtcctgctcggttgcccaggctagagtgcagtggtgcaatcaaactcactgcagcctcccaggctcaggcgatcctacctcagcctcttgagtagctggcactacaggcatatgccaccatgcccagctgttatttttttcactcctttttgttttggtagatacagagtctccctatgttgcccaggctggtctcgaactcctggactcgagtgctggcattacaggcatgagccaccacacaaaaatcttatgaagagaaacaaattttcttaaatttccccccaaaaaatagtggatgtccaaaaggctgattgaaaacacctacatacaaaataaaacaaacaaacaaaaaaagatttaaagaaaaaggcctggtgcagcagctcactcctgtaatcccagcactttgggagggtgaggtgggaggatcacttgagctccggagttagagaccagcctgggcaacagagtgagaccctatctctacaaacaaaattttaaattagccaagtgtggtagcatgtgcttacagtcccagctactccagaagctgaggggattgcttgagcctgggaggtcaaggctgcagtgagtcatgatcatgccattgtagtccaacctgggcaacagagcgagaccatctcaaaatgaaaagtgataaaaaaataaaaacaccaacatatttcaaatcactcttggaatagtcatgttgactctccaatatccactctattctgattagttttaacccattctctttgccaatgattggttaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagcctgaagatgccaccaacatcaaagggaatagagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaatgattgagttctaatgttttttagtatttgtatcttactttatgattacagtattttatataactaatcttattatttcttcctcagaaaagacattccatggccaggcatggtggctcacacctataatcccagcactttgagaggccaatgtgagagtattgcttgagcccaggagtttgagaacagcccagggaaaacagcaaaacttcatctcttcaaaaaataaataataaaaaaatttagccgggggtggtggcatacacctgtagtccaagctactcagaggctcaggcaggaggatcacttgagcccaggaggtcaaggctgcagtgaaccatgatcacgccactgcaaaccagcctgggcaacagagcaacaccccgtctccaaaaaaagaaaaagaaaggaagggaggaaggaaagaaagaaaaaaggaaaaggtgttccctcttacacacagctctgtatccatccatctttgtctgtgttctctctacctagaaaaagaggaccatccctcattaccaccattccttgttaattcctctctccaatccacctacaactcatgttatcctcttatattccaccacaccactgttatcgtctactcacttcacttgacaataatgtaggctgggcgtggtggctcatgcctgtaatcccagcactctggaaggccaaggcaggcagatcacctgaggccaggaattcgagaccagcctggccaacatggtgaaaccccgcctctactaaaaatacaaaaagtagccaagcatggtggtgcacgcctgtagttccagctactcgggaggctgaggcatgagaatcacttgagcccggaaggcagaggttgcagtgagccaagatcacaccactgcactccagcctacgcgacagaaggagactgtgtctcaaaaaaagaaccaataatgtacagagttggcactacattacccttggttaaatgctgtctgtaattcctctgagtttgttttcatataccagtcttgccacctcaagccagcctgaaagcccttgcaggcaggaactgtggttgttctaatttaagatctgtaactcatctatagataataaacgtattccaaaaaggcactctctaccttccctgccacagaccttctaaacaagccagaaattcctaaacagaataatctcacaaattcagtacctcgtatgtccaaactaatctcaaaaggacaatgaataactttttttgcacttaagaaaaagcaattattatatattaactcaggacaagttctaaagcctaggccatttagtttcaaaagcacaggggcccatttttttggttacttacctaggacctagcccagggcctggcacaaaagagacacatcataagaactgactgaataaatgaaaaaggtagagtgtagtacttaagcacacaggacctaggtagcccgattctaatcctgcctccctcacttattctttgtgttactttgggcaaagtacgtattctgctctgtaaaatggagatagtaataccacctacctcttaagtttaactattattattagtgaatgaagctattttccacagttctaaactttaaaggttaaaatctgagtgaagcaaaaatcagcacctctttcctaattcaaacttcaaacacctatctacttaggacttggacctactttaattaaaaaaaaaaaaaaaaaaaaaaaaaaagcctggatgtggtgactcacacctgtaattctagcactttgggagaccgaagcaagtggatcacctgaggcctggagtctgagaccagcctgggcaacatggtgaaaccctgtctcaactaaaaatacaaaaattagcctggcattgtggcacatgcctatagtcctagctacttgggaggctgaggcaggagaatcgcttgaacccacaaggtggaggatgcagtgagccaagatcgcaccactgcactccaacctgagtgacagagcgggactctgtttcaaaaacaaaatccctgtctagactctagcaaacaatgttttcattcatgaacttagataacactatatataaaaatacttttagctccctaaaaacatattctgagaatgattatttacaatcataaatctaatgccacattaaatacttcaaatacatttaattcaacaaaaatctagtgagtacctattaagctcaagaatttattctagatatcacagaaatgaacacataaacctatgtaaaaacccatattaaaattataaaagaaacatctttaagctgaaactgaggcatgttctcacattaatatttaaccagctaaatattaaatagccagagtcaactaaaccaaagttaagaaatttaagtcaaaaaatttaggatgtagaaggaatatgttcagccgccacattttattagtgtgaaaatgaggccaacagaaagaagccagttaagagattgccaaagcgtcaaagctggaatcagggtctctcagtcttcaattctcacttttcccacttctaattcaccagtgctactcaattggtgaactggatgtgcaaacatgctaaaggcattaaacctaaaccatactacctatttcacagtgtcacaagtataaagatttagccaaatgcaagtagaagaaaatcctcatactgattacaatgactacaaagctcagaaatcaagattttttttcattaaatggaggccttagctgattcaaaatatcatacagtatttttatgtactgactgaatccagtagaaacaaactttcagtaagattaaacaaaagcatttcataaatggcaaagtattacaagaatgcatagcattccttcatttcaatccaacctaacaagatattttcctcctcatactactgatacaaactgcaggatttacataaagatattattttgccatctcaccacagaactgacccaataattcatacaaaagaaaaactaattattaggcagcctcctaatttaactgtgttagtaatgagaacaatactgttgtaggttaaacctaaatgtactagtaagtctagaaataatttactttaggataattcagaagacaacattaaagctcagctgaatacaattatatcactgaaagaaacaagtcaggttctctcaggccatcagctattgttaaaatctaacacccaagattgttggtcttctccacagtggtggatttaatagcagctaccagcactcatttctagtgcaagcagtttaagcaggattttatacgaacattttaataaagttcctcaatgagtttacacacacacacacacacacacacacaccctgattattttggtgaattttagttaattctaatgtttttaactttagaatattttaaaattctcaaataactagaatgtgtgaacgttcaatgaccaaacatagaaggagtattctaatatactgattttgcagattaagcaatctacgcaggacccaaactttttatcagataataaagctgagtgtcagaatttggccaaaatgtaccaagaaactacctgagttcttttccaaaggaaacataaaggtaaatatgcagaacttcaaggcagctgtgagcagccaagttgtggagggcctgacaaaagtgagtcagaagggaaaatgttcaaagagaaaaggaggcagcaggtgtacaaggcaaaacacaccttaaaaaatatctttacaggctgggtgcggtagctcatgcctgtaatcccagcactttgggaggccaaggtgggcagatcacgagatccggagatcgagaccatcctggccaacgtggtgaaactccgtctctactaaaaatacaaaaaattagctgggcatggtggggggcacccgtagtcccagctactcgggaggctgaggcagcagaatggcatgaacctgggaggcggagcttgcagcgagcggagatcacgccagtgcactccagcctgggcgacagagcgaaactctgtctcaaaatatatatatatatatatttttctttttacgtcagttgctgattctaagttatgatgcaacttgtaaaatcttgttctgatggcatggcaaacctagggactttggaagatggcagacctgtttcctccaatgaagcagcataccattcttggaaagggaattactttttttttttttgagacacagtctcactctgctgcccaggctgccaggctggagtgcatggcaaaatctgggctcaccgcaacctccacctcctgggttcaagcgattctcctacctcagctgcccaagtaggtgggactacaggcgcgtaccaccatgcccggctaatctttgtatttttagtagagacggagtttcgccatgttggtcaggctggtctcaaaatcctgacctcaggtgatccgcccatctcagcctcccaaagtactgggattacaggcgtgagccaccacgcccagcctagaacattatttttaacccactaattcttggattcttgaacttgtttctatgtacactcaggaacatacagctacaaacggggagtaaccaaagccactgaatatatgcaggagcaacttttttggagtatcaatttaatcaaggattatagtaaaatcagatatacttttgttaaaataaacacaaatatattacaggttgaccatccctaatctgaaaattcaaaaccctccaaaatctgaaactttttgagtgccaacatgacacctcaaatggaaaattccacacgtgacacctttgcttctgatggttctctgaaccatcagaaacactgtttatttcaagaacaaaattattttaaattttgtataaaactggtcggttgtggtagctcatgcctgtaatcctaacactttgggagaccaagatgggaggatcatttgagccctggagttcaaaaccagcctgggcaacatagtgagaccctatctctgaaaaaaaaaaaaaaattaagtccaggtacagtggctcaggcctgtaatcccaacactggaaagccatggcaggtgaatcacttgagctctggagttcaagaccggcctgggcaatgtagcaaaacctatctctaccaaaaacacaaaaaattagccaggcatggtggcatgcacctgtagtcccagctacacaggaagccaaggtgggagaatcacttgagcctggaaggtggaggctacagtgagcagagatggcgctactgcactccaacctgagtaacagaatcagaccccatctcaaacaaacaaaaaaattagctgggcttggcaccgtgcatctgtaccagttagtaccagctacctgggaggctgaggcaggagaatgacttgagcccaggagttctaggctgctgtgagctaggatcacattactgcactccagcctgggcaacagtatgagacatcatctcttaaagaaaaaggtaaaaaaaagaaattatcttcaggctatgtgcataatgtgtacatgaaacatagaatttcatgtttagatttggatcccatctccaagatagtacattatgtacatgcaaacatcccaaaatctgaaaaatctgaaatccaaaaaacttctggtcccaagcatttcggataagggatattcaatgtatacagagcaaaaggcagaattctcactgtttcaagatagaaaaggagtcctcagagagatatgtcctgcttgtaacaaacagctccaaacagccctagaccctgaaaagtactttaaggaaagataaagaggtactggtttagaccatttatagataaatatgcatggctaaaacccctgaatgtaatccttccaggcagaagataaaacctgaaatctaacgtataaattgtcatgggtacaatattataaaagagaccataagttaccgagaacatgactggaattcaggaaatgctaaaggtcctgtcttatctctgtaactcatttacaaagaaatcatgtatgattttctcaactgcaatcttttttgtttctgaattagactgacaaaaattatagaatataatattcaatattttccaccatattccaaattctcactatcacatttaaacacaattttatctaatgaaatgtgtcccaaatgaaccaactttaaccagcatcagaaaaaataaaataaaatagttaaatgaaactgtatcttctttggtataagaagtccttcaggccagacgtggtggctcacatctctaatactagcactttgggaggccgaggccagtggtttgctagaactcaggagttcgagaccagcctgggcaacatggtgaaaacccgtctctactaaaatacaaaaaattagccaggcgtggtggcatgcgcctgtagtcccagctactcgggaggctgaagcaggagaattgcttgaacccagcgggaggtagaggttgcagtgtcagtgagctgagatcgcgccactgcactccagcctgaacgacagagcagactccgtctcaaaaaaaaagaaagaaatccttcagcacagagggtaggaaaaaacaactactcacacttcccagaatacctaccgtggcaataccaaaatatgaccatgcttgttaatatttgggctacggcattaaatgtttataacataacacaaacacttgtaatccaaatgtgaatgattatcttcaattttcagtaaaataagaccctataaaagccctaccattaatacatattcattcataaacatactgagtaccagtggatgttaaacactgtagaatctctaaggaaagaatactcggtcactttataagctatgtggtagtcaagaaaaatcctttctactcattgatacgttaaatgatcaaaaaatccaaagctaaaaaatgatcagagaacaatgaaaaaattttagtggctttatgcttccaattccattttcttctggactcttttctgaagcttgcctaaatcatcccaggaatgctaaaattgggtgttatttatggcataaccaaaatgaaataacaaagtaagtaccccaaataaaactaggagaaaaaatccagggaaccaagcaggcagtaaggatctaaagttctatacttggaacctctaccctgaatgttaaataatagatgttttttaaatagttgactaccaagtgtggtggcatgtgcctgtaatcctagctacttgggaggctgaggtggagagactacttgagcctaggagttctagactagtctggacaaatagcaagaccctgtctcacgggtaggggagcaggggaaggcaaccaagctgggtgtgccatgtgcctctagtcccagctacttgggaggctgagacaggaggagtgcttgaaaccataggccactgtactccagcctaggcaacataggaagaccctatctctaaaacaaacataaacaaaaaggccgggtgtggtggctcacacctgtaatcccagcacttgaggaggctgagttgggaggatcacttgaggtcaggagttcgagaccagcctggccaacatgataaaatttttgtatctttagtctctactaaaaacaaaaattagctgagtgtggtggcaggggcctgtaatcctagctacttgggaggctgaggcataagaatcatttgaacctgggaagtggaggttgcagtgagcggagatcacaccactgcactccagcctgggtaacagagcaagactctatctcaaaaaaacaaacagttatatctttaattattatcttcattcagtaattaggcaattagaatttacaattgctaaatgaatgttcaaagttcaaccaaaattagtccaagatgaagccaagaacacatctcaactcattcaataaagccattattactctgatgccaaaaccagacatagatatcacaagacaactacagaccaatatatcttatgaatacagatgtaaaagtcctcaacaaagcaaaatgaatccagcaacatattaaaaggcttatacaccattgctaagtatgacttaatcccagggattcaaggttggcttaacttctgaaaatcaattaatgtaatacaccatattaataaaggatacaaaccacatgatcatttgaatagatgcagaaaaagcacttaacaaaatccaacatgctttcatgataaaaacactcaacaaagtagaaattgaagaaaacatcttcaatctaataaaaaatacctatgggggaaaaaaagaatacctacaaaaaccccatagctaaaatcatacttaatggagaaagcctgaatgctttctccctcaggtcaagaacaaaacaaggatatccactcttaccactctgtttaacactgcactgaaggttatggccagggcaaataggcaagaaaaagaaataaaaatcactcaggcttaaaaaaaagaaggaaaactacctttatttgcagatgatataatcttgtatatagaaaatcctaagaaaatcccacaaataaactattagagccaataaacacatccaacacagttacaggatacaagctcaatatacaagtagtaatcgtatttctatacacaagcaataagcaatctgaacatgaaaagtttttaaaaattccacttacaatagcatccccccgccaaaaaaaaaagacttagaaagccaagcacgatggctcacacctgtaatcccagcactttgggaggccgaggcaggcggatcacttgaggtcaggagttcaagactagcctagccaacgtggtgaaaccccgtctctactaaaatataaaaattagttgggtgtggtggcaggtgcctgtaatcccagctactcaggaggctgaggcagtggaatcacttgaacccaggaggcggaggttgcaatgagccgagatcacaccactgtactttagcctaggtgacagaatgagacactgtctcaaaaaaaaaaaaaaaaaagacttagaaataaatttaacaaaagcagtgacaatcttatactctgagatatataaaaattacaaaagaagttacagaaatcctaactaaatggaaaggccaggtgtgatggctcacacctgtaatcccagcactttggtagactgaagtgggtgggctgcttgagcgcagaagttcaggatcagactaggcaacatggcaagaactcatctctacaaaaatacaaaaatgagctagatgtggtggcatgcacctgtaatcctagctgcttggggggctgaggagggaagatcacttgagcctagtaggttacagctgcagtgagccatgattgcattactgtacttcactgcagcctggatgacagaacaagactgtgtcccccaaaaaaaaaaaaaaaaaaaaaaggaaagatatcccatgttcatggatgagaatggatcagaagatacaactctgttaaaatggcaatattccctaaattgatctacagaatcaatgtgatcccagcatacccaaaagaaatttgaataggaaaaacaaagttgggggactcacacttcctgatttgaaaacataattcaaagctatggaaatcaagacagtgtggtagtggcataaggataaacatacagatcaatggaatataagtgtgggttcagaaataaacctttacactgacagtcaattgattttatgacaaaaatgccaagacaattcagtggaggaaagaatggtctttttaagccaagtgctgtagctgacacctataatcccagcatttggggaggctgagacaggaggattgcttgaggccaggagtttgagactagccagggcaacaaagcaagacccccatctctacaagaaacaaacaatggtcttttcaacaaaccatgctgggacaactgaatattcacatgcagtagaatgaagctggaccactatatctcacaccatacacaaaaattaattctaattaaatttaaacacggattatagacctaaatgtaacagctaaaacaataaaattcctagaagaaaacaaagctaatcttcatttcatttggtggcctgacatcaaaaccacatgcaacaaaggaaaaaacaagtaaatttggcttcatcagaattataacattttgtacattaaaggacaccatcaagaaattgaaaacacaacccatagatgggagaaaatatttgcaaatcatgtatctcacaagggatttgtatctagtatatttaaagaactcttacaactcaacaataaaaagagaatccaattttaaaatgggcaaaggctgagcatggtggctcacaccagaaggagaggatcccttgaggcaaggattctgagacctgccagagcaatatagcaagaccctgtctctacaaaataaattaataataataaaaaaaaacaattagccaggcatggtggcacacacctgtagtcctagctactcaggagcttgaggcagaaggaacccttgagtccaggagtttgaagttccagaaactatgattgggccgggtgcggtggctcacgcctgtaatcctagcactttgggagtccaaggcgggtggatcatgaggtcaggagttcaagaccaacctggccaagatggtgaaaccccatctctactaaaaatacaaaaattagctgggcgtggtggtgggtgcctctaatcccagctacttgggaggctgaggcagagaatcacttgaacccaggaggcagagattgcagtgagccaagatagtgccactgaactccagcctgggtgacagagcaagactccatctccaaaaaaaaaaaaaaagaaaagaaaactgcgattggccactgcactctagccagagtgacagagcaagacctagcctaaaaaacaatagtgtataaaaataaaattaaaatgtgcagagaatttaaatagacatttctccaaagaagatatatgaatggccaataagcacatgaaaagatctcatcaggttgagcacaggggatcaggcctgtaatcccaacactttgggaggccaaggtgcggggactgcttgagctcaggagtttgagaccagcctgggcaacatggtaaaaccccatctctacaaaaaatacaaaaaggccaggtacagtggctcatgcctttaatcccagcactttgggaggctgaggcgggtggatcacctgatgtcaagagtttgagaccagcctggccaacatggtgaaaccccgtctctactaaaaagacaaaaattagccaggtgtgatggtaggcgcctgtaataccagctactggggaagctgaggcaggagaatcacttgaacctaggaggcggaggttacagtgagccaagatcacaccactgcactccaacctgggtgaaaggcaaaaatccgtctcaaaaaaaaaaaaagtttcaaagataaaacaaaaatcttgttaaagataaatacacgagatgctaaagaaataatctacttcttcaagtcatgctatcaatttgcaccaaaattttcatttcctatgtgtaggtgttgagggtcttgtacccatgataaatgacatacacctgttctgggctgacttttgttccccaaaagagatatatagtactccaaggggctgggcacagtggcacatgcctgtaatcccagcactttggaaggtcaaggccacagcatcgcttgagctcaggaattcaatatcagcctgggcaacatggcaagaccccggctctactaaaaatataaaaaaatagccaggtgtggcagtgcacacctgtagtcccagctacccgggaagctgagatgggaggattgcttgagcctggggtttagggggctggaggttgcagtgatccaagtgccactgcactctagcctggatgacagagggagaccctgtctcaaaaaaaaaaaaaaaaaaaaagatatgtagtactcctaacattcagcacctcagaacctgatcttagagacaggatcttcaggccaggtggcttcccttcctctccgcgtcagtctgtcccacctcagctcagcccaccggagacagagggtgcaggaacctggaggcggaggttgcaggaagccgagatcctgcaactgcactccagcctgggcgacacagcaagactccgtctcaaaaaaaaaaaaaaaaccttacaacaaaatgatgcagcccgggcgcagtggctcacgcctgtaatcccagcactttgggaggccgagtggggcggatcatttgaggtcaggagttcgagaccagcctggccaacatggtgaaatcctatctcaactaaaaaaaaaccaaaaactacagaaattagccaggcgtgatggcgcatgcctgcagtctcagctgcttgggaggctgaggcaggagaattgcttgaacccgggagtcggaggttgcagtgagccaagattgcgccgattgcactccagcctgagtgacaagagcaaaactccatctcaaaaaaaaaagaaaatgcaaagtcacctaagagacagtttaaatacataaaaagctcgatgccaaataaaactggatgggtcacttgataagtgggattgataaaaagcaagacagctgatattatataattcttatttgcttcgatatttactggggaaggtagaggggaaaagctatctaaattactcttaataagcatacaaatctctaatagtgaatcaaatgcatcattaaatatactaaattcctcaaactgatatgtcagatgtcaggtagtcatgaagacccaaaatagtctccatgggttttttgttgttgtttttttgagacagagtctcactctgttgcccaggctggagtgcagtggcaccatctcgactcactgcaacctctgtctcccgggttcaagccattctcccacctcagcctcccaagtagctgggattacaggcatgtgccaccacatttggctgatttttgtatttttagtagagacagggtttcactatgttacccaggctgttctcaaactcctgacctcaagtgattcacccaactcggcctcccaaagtgctgggatttcaggtgtgagccaccacgaccagccccttctctgtgttttaaaggcatttaagtataaattattaaactgcaggacagaacatattagctgacggtcatatgagtgaccttctctaaatgccaggaggatagaatccacttttcctttatcaatattttccttgctcaacttctgacatattaggtactcaataagtatgtgctgaaccaaaacgaacaaaaaaatgctgtcatcaaagtaacttccatctactcaagtaggctgcaacttcaaactgcccaaactagcaaatctctaataaagatgggctcagaagacatatcagcatgaataaccttctgaggaaaagacaacatggattctaaaagtggacatcacaccacaccagttcacccaaattctctgagaaaataaatatgtgtggctgggtgacggtggctcatgcctgtaatcccagcactttgggaggctgaggcgggtggatcatgaggtcaggagatcgagaccatcctagccaacatggtgaaaccccaactctactaaaaatacaaaaattagctgggtgtggtggtgagcacctgtagtcatagctactcgggaggctgaggcaggagaaacgcttgaacccgggaggcggaggttgtagtgagccgagatcgcaccactgcactccagcctgggcaacagagtgagactctgtctcaaaaaaaaaaaaaaaaaaaaaaaaaaaaaagacctgagtggccacaggatgagaacatttactgtagactggacataactgagacacagaaaattataggtagatgctgaggtacttccccaaatgaagaagtaaaaacagaagattgaaaatttttttagaaatgctatatttaacattttaatatattgtacaaaaaatatacagagaattccccattttgcagatgggatgatgagattcctaataatgaaataccacacgagttggaaaaataagggaacggagtgatggaaagggtttctaaatatattaaatgagaaacatttgcaaaaactaagatttatattcagcttagagaatgctttggcaagtataaaagctgtctaaatatgtgaagggttatctagcagaagacaaaccagacttgctctaagcagttcccgtgtagacaaaattgggcccaaagtggcaattccagaagggcacgcttcaactcaagctttctaaccatcagacctaactaaaaaggtggttcttaccttggattacctctaagagcccactgagatatgagtgttaaaaaattacatgcgaggaaatggcaggtatgttacagcatggacaaatgaaaagtaaggcatttacaggaaaaaaaatctaagctatacttaaaagactcatgccttcaagtcaaaaaaggaatttttgaataattatagaatattccctaaagacaatgtgatgttctatgcaaaaaaaaaaaaaaaaaaagggagggagggaggaccaaatcctattaggaaaaaactgtaaatcaagggtacccaatcgtttggcttccctgagccacactggaagaagagctgtcttgggccacacataaaatacactaaagtaacaatagctgatgagctaaaaaagaaaatcttaaaaaaaatctcataatgttttaagaaagtttacagatttgtgttgggccacattcaaagctgtcctgggccgcatgcagcctgtgggccatgggtcggacaagcttgctgtaaatagaacatattttcttatccttctaccaaatcacagtgtagttataactaaaatgcagttctgagtagttatcataaatccagaaagggaaagcaatgctgacaaagatcctggaaggaggtttcactggagattaaattaaaaagtcaagcatcttcagttgagaaacatgaaagcaaaggggcaatgtgatcaaaatcagaaaacgtatcaatatggtaaatactaatttattcaccttttatgcttgaaaagtatttctttatataacagataaaagaaacttgtggattgtgttaccacaatctacaagttaaaaatagattcaagtgctcggataaatgtaggtatattaggtccattcaggtcctacaggatagaagtgctatcagacgtgaggccctaaatttctgaggttaacatcttaacagataacaatgtttcacctgaaaacatcacttggtgccaatttagacagaacaattggttggacagaccccggacagacagactcaaggaggctggttggtatagacttccttccattcttttacctcagtatgtatgtgtgtgtaatatatacatacatattatactagaacatatatacattccttatctttatacacttagaatgctccttatatagctctgcaccctgaatttttcatttatcatttactcaacatcctaagacattaaaaattctttttttttttttagacagagacttgctctgtcaacaggctggagtgcagtggcaccatctcagctcactgcaacctccaactccctggtccaagcaattctcctgcctcagcctcctgagtagctgggatttcaggcacgtgccaccacgcccagctaatttttgtatttttagtagagatggggtttcaccatgttggccaggatggtctcgatctcctgacctcataatccgcccacctcggcctcctgaagtgctggaattacgggcatgagccaccgcacccggccagaaaaattctttcaaatactattccatggttgtaaatgtccatccttaaatataccatgatttattttcctataaatcttgctgctcatttaggtttattctcaattctcactaatatgaataatgttacaatgaacatctttgttcacaaatctttctatgtatcttaatttttcccctttaggataaattcctagatgtgcaattactgaattaaagaacgtttttaattttgccaatatatgttgccaaaatatctttcaaaaaaactaggcccaatgcacactccactagcagtttcagagattgtcccctcaccaccttcgacagcacagtcaactgtaaatctgataggttaaaaaaagagtatgtcatttaatctgcattcctttgattacttatcaggataaaaatgtttctcatatgcttcttggtcatttgtatttcttccttatgaactctgatcatgttctttgccagcaaaacttttctttctcttggccgacaaactttctgtggaaaaccagctgagatggaatcatttaaatatcagcaactgcagctccccctgctgacagataaattaccaccaccatcaagtgcccagtaaaaaaaagtgagctagaaccatacgcttgcctgtcttctgggctgctgctacaaatacaaattatacacggtaataaaaaagaaaatactgtgtatctaaactcatacttaacagagctgtgatggagaaggcaagggggacaagcgttttatttgttttttgttgttgttgttgttgttgttgttttttgagacggagtctcgctctgtggcccaggctggagagtagtggcgtgatctcagctcactgcaagctccgcctgctgggttcacaccattctcctgccacagcctcccgagtagctgggactacaggcacccaacaccacgcccggctaattttttttttttttttttttttagtagagacggggtttcaccatgttagccaggatggtcttgatctcctgacctcatgatgggcccgcctcggcctcccaaagtgctgggattacaggcgtgagccaccgtgcccggcccaaacgttttctaatgtgcaggaactaggcggggtgcagtggctcacacctgtaatcccagtactttgtggaggccgaggtgggtggatcacctgaggtcaggagttcaagaccagcctggccaacatggtgaaaccctgtctctactaaaaatataacaatcagccgggtgtggtggcacgtgcctgtagtccgagatactcaggaggctgaggaacgaggattgcttgaacccaggaggtggaggttgcagtgagccgagactgcgccactgcactccagcctgggcaacagagtgagactccatttaaaaaaaaaaaaactaatatgcaagaactaatgtcacaaacaattctaaaaatcaattccctgccaaatatactacctggcacatataaacatcacagacctaaatattcatttccctatactttaactatgtgaaaacactctaaattaccaaatgacactgggtggtcagcaaactagttctctttttccaaaagcaaaaacaacaaaaacacttttgccctttagcattcaaagaaagagtattaaaaatcttaattcttggcaatccttattccaaagttgcttgcacttatcagactgggaccaatagatccaaagagtaaggccaagactggcaaatgcatgtgactctcagcttttccactgataccctcctaaagatgcatgtcccaagtccagcaatacagtctttaacactcatttactaagtgccatcaagagcaagcagtgatggccgggtatggtggctcacgcctgtaatgccagcactttgggaggctgaggggggtggatcacctgaggtcaggagttcgcaaccagcctgaccaacatggtgacaccctgtctctactaaaaatacaaaaattagctgggcgtggtggcaggcacctgtaatcccagctatttgggaggctgaggcaggagaatcacttcaacctgggaggcagaggttgcagtgagccgagatcgcgccgttgcgctccagcctgggcaacaaagagcgaaattccgtctcaaaaaaaaaagaaacaaaaacagcaagcagtgaggataaaagacaagagcaagtcctcactctcaaagaacctagacactagctgggttcaaagtggagcaaactagcaatcagtacaatagaagtgctaggtctgcatatgcacactcacatgcacacacactaacagtttcagagattgtccccttaccacctttgacagcacagtcaactgcaaatctgataggtaaaaaatagtatgtcatttaatctgcattcctttgattatttatcagaataaaaatgtttctcatatgcttcttggtcatttgtatttctttatgaactctgatcataaagtgataatacctgggtccagaggaagcactcagtgtcagctactgttattactattatcactactgttattttgttttaaggctaatcaagtgaagcagtgggagtggagaaggaacaaagaaatctgtaactggctgtgatcaattaatagtaaacaccaatatacttggaccagccactactgttattaaagactagggggagtaagtttccagaacagggtagagtccatcttaagcagaggtaactgcttgtgtgaagacccagaggcaaagaacaacagggttcacagaaggaactgggcacaagctatctgtactactgcgtacaggatgctcaggaagaagtggagagatgatctggcaaaacatttcaactctaccttcaaagctagttgagccatggtggaagagggagggatatgatcatacgcttgaacatgcattttacaaggatcatgttggcagcgacttggaagagagaaagcagtcaaggagaatgattacaagacaacagaaggtcacgcagccaaaagggcgatgaaggtctggactcaaaaaggagaagtaggatgactaggaaaatattatgagctaggatctcaagaatgtggtgactagaatggcacaagaaggaacccagaggcctctcaaatccctgatttgagtgactggctgggtgacactaccgctcactaagatacgaagataggaagaggttggactggggaagtggataagatcattttaaaatgcccataagatggccagatgcagtggctcacgcctgtaatcccagcactttgggaggctgaggcaggtggatcacctgaggtcaggagttcaagcccagcctggccaacatggtgaaaccccatctctactaaaaatacaaaaactggccggacgtggtggcgcacacctgtaatcccagctacccggaggctgaggcaagagagtcgctggaacctgggaggcagaggctgccgtgagccgagaccgtgccactgcactccagcctgggggatagagcgagactccgtctcaatagtaataataataataaaaaaataaaataaaatgcccataggacatccaagtagagatgtccaggaagcaactgtgtatatgggattggagatcagaaaactagtcagagctggaaaaacacacatttgcaaatcatcggcatatagacggcaagtgaggcacaagtttatctaaggcattcctcataaactgcacagggtgagaggaagaagggtcaagggaaggcaaatactaatgtttttaggagcaaaagaggaaaaaagtctgcaaagaaaaccaagagtatgggccagacttggtgactcacacactttgggaggccgaggcaggtggatcacctgagatcaggagttcgagaccagcctggccaacatggtgaaacccatctctactaaaactacaaaaattagccagatgtggtggcgggcacctgtaatcccagctactggggaaactgaggcaggagaattgcttgaacccaggagacggaggttgcagtgagccgagatcacgccactgcactccagcctgggcaaaagagcaagactccgtctcaaaaaaaaaaaaaaaaaagtttcaaagataaaacaaaaatcttgttaaagataaatacatgagaagctaaataaataatctacttctttaagtcatgctatcaatttgcaccaaaattttcatttcctatgtgtaggtgtcgagggtctagtacccatgataaatgatatacacctgttctgggctgaattgtgttccccaaaagagatatgtagtactccaggggcctgggcacagtggcgcattcctgtaatcctagcactttgggaggccaaggccacaggatcgcttgagctcaggagttcaatatcagcctgggcaacatggcaagaccccatctctactaaaaatatttaaaaatagccagatgtggtagtgtgcacctgtagtcccagctactcaggaagctgaggtgggaggattacttgagtccaggggttagggggctggaggttgcagtgatccaagtgccactgcactccagcctgaatgacaaagggagaccctgtctcaaaaaaaaaaaaaaaaaaaaagagatatgtagtactcctaacattcagtacctcagaatgtgatcttagagacgggatcttcagaccaggtgcagtggctcacgcctgcaatctcagcactttaagaggccgaggtgggtggaccacttgaggtcaggagttcgagaccagcctggccaatgtggtgaaaccccatctctaccaaaaatgtaaaaattagctaggcacggtggcgagcacctgtaactccagctacttggaaggctaaggcagaagaatcacttgaacctaggaggaggaggttgcagtaagctgagatcaccccactgtactccagcctgggcaacaaagagagactctaaaaaaaaaaaaagagataggatcttcaaagaggtcataaagttaaaatgaggtcatcagagaggactctaatcccaatatgacttgtccttataaaaaaggggaaattgtggacacaaagaaatacacacagggaggctgggcgccgtggctcacgcctgtaatcccagcactttgggaggctgaggtgggcagatcacttaaggtcaggagtttgagaccagcctgggcaacaaggtgcagccctgtctctacaaaaaatacaaaatttaggctgggtgctgtggctcatgcctgtaatcccagcactttgggaggccaaggcaggcagatcacctgaggtcaggagttcaagaccggcctgggcaacatggtgaaaccctgtttctacaaaaaatacaaaaaattacctgggcatggtgacacgtgactgtaatcccagctacttaggaggctaaggaaggagaatcacctgaacctgagaggcagaggttgcagtgaaccgatattatgccactgcactccagcctgggcaacagagcaagactctgtctaaaaaaacaaaagaaatacacacagggagaactctacataaggactggagttatgctgccaccagaagctagaagagaggcttgaaacagatcctgtcccagttgcttcagagaaagcatgcctctgcccttagatttctagcctccagaacagggagacaataaatttctgttatttaagccactcagcatatgtcactctgtggcagcagccttagcaaacagatgtcataagaaaattcgcagctcaggtttactaagtacctaccaggtgctgttctaaacactctgcgtgaataaactcatttaatccttataaagtccactctaggatctaggtactatcattataccctttttacagtgtggacaccaaggttctaagaggttaatgagcttacccagtatcacatagccagagccctctctctcaccactagtgtatgaggagctattattaacagtaattacaataagagctggcgtggtggctcacgcctgtaatcccagcactttgggaggccaaggcgggtggatcacttgaggccaggagtttgagaccagcctggccaacatagtgaaaccccgtctctactaaaaatagaaaaataagccgggcatgctggcatgcgcctgtaatcccagctacttgagaggctgaggcaggagaattgcttgaactcaggagacacaggttgcagtgagccgagatcgtgccactgaactccagcctgggcgacacagcaagactccatctcaaaaaaaaaaaaaattagtaattacaataagaacagtagtagtccactgaaccaaacactgccctatgtcctttacagatataatacaaaagtcctctgaagtaagtgttattatttccagtatgaaggaggaacctgaatctcagagagattaagaaaatcgcccaaagtcacacggttaagagtgctgagattaggccgggcacggtggctcatgcctgtaatcccagcactttgggaggccgaggcgggtggatcacctgaggtcaggagtttaagaccagcctggccaagctggtgaaaccccatctctactaaaaataaaaaaaaaattagctggccatggtgacaggtgcctgtaatcccagctacttgggaggctgaggcaggagaatcacttgaacccaggaagtggaggttgcagtgagccaagatcacctggacaacaaagcgagactcttgtctcataaaaaaaaaaaaaggaagaagaatgctgagattatatctaattgctaacttaaggggatatacaatgaaaacctgtttttactaaaactttaagaacaagttaattttttttttttctttaatgagacaagagacaaggtctggctctatcacccaggctggactgcaggggcgcaatcacagttcactgcaacctccacctcccaggctcgagccatcctcccacctaggcctctcaagtagctgcaactacaggtgcacaccaccatgcctggctaattttcttttgtatttttagtagagatggggttttgccatgttgcccaggctgttctcaaactcgtgtgctccagcgatctgcctgttcagcctcctaaagtgctaggattacaggcgtgagccatcgcgtctggccaagttaaattttttaatgcctgactttgcagttcaatactagaaatatacatctataaattcaaaattcttgaagatcccaagagaacacatgtcctagattatgggcccttttgcgtgtgtatcccctcaaccactgttcaagaactattctctcggctgggcacggtggcccacgcctgtaatcccagcactttgggaggccgagttgggcggatcatgaggtcaggagatcgagaccatcctggctaacacggtgaaactccgtctctactaaaaatacaaaaaattagccgggcgtggtggcgggcgcctgtggtcccagctactcgggaggctgaggcaggagaatgacatgaacccaggaggcacagtttgcagtgagccgagattgcgccactgcactctagcctaggtgacagagtgaggctccgtctcaaaaaaacaaaaacaaaaacaaaaaaactattctctcagttagaacccttgccatttctctgacttccagacacagaaagagaagaaaaggaaggattgagatgctgttctttaaaatttttttttttttttgagacggagtctccctctgtcgcccagactggagtgcagtggcacgatctcggctcactgtaaactccgcctcccgggttcacgccattctcctgcctcagcctcccaagtagctgcaactacaggcgcctgccaccacgcccagctatttttttgtatttttagtagagacggggtttcaccgtgttagccaggatggtctcgatctcctgacctcatgatccgcccgcctcggcctcccaaagtgctgggattacaggcgtgagccactgcgcccagctaaaattttcaattttctatttaatttttaaaatctgatacaaacatcagaaagtgtaaaaagatataatgcaatgagaagtctccttcctactctgtcctctacctgaacaattcctagacctaacaggtaaccagtgccaccattttcttatttattcttctaaaggtttgtgttgttgctgttgtttgagacagagtctcgcttggtcagccaggctggaggacagcggcgtgatctcagctcactgcaagctccgtctcccgggctcaagcaattctcctgcctcagcctcccaagtagctgggattacaggtgtgtgccaccatgccccagctagtttttatattttcagtagagacggggtttcaccatattggccaggctggtctcagactcctgacctcaggtaatccacccaccttggactcccaaagtgctgggattacacgtgtgagccaccatgcccagccctaaagatcttttttttttttttttgcatacatacaccaatgcaaattatctttttctcctgtttttttttttccaaaaaacacaaagggtatcaaatcatacatactgttctgcatcttgctttcatcacttaactgtctgccttgcagatctttctatatcatattaaattatgttttaattctctcgttttgcttgtcaagaacagtttttacttcatttcaccatagttcagtctagcacacaaggcatccagcagccctaagaactacctgaaacaactgatgatggctccatgctacacactaaagaccctgtatcttttctctcctcctcatcttcatttcactcttttctccgactcactcaattctccttcctttccctattcctctcccatctcacccactccttagccctaaccctgacaactagaccctagtaacatcactgacattgcttagtcgtggctagaaatattcaggctttaaaaaggtacagacccctaacacagagaaaaagggataaataataatttccatgagaacttctaattaacgagagtgccttaaattgaggagttttggcttggagttattcttccttgttacttgcctcctctggcattttcatttgtgaagactgagtgagtgtgacgctattttctatacgcatggaaacaagcacatactcagtctaacatttacgcaatgcctgacagaacgacagagttcattctacaataagataattggaaacaaaatataagatctatataaaataaacatttgggctccaaaatatgcactttaattaacctatcatttctttttacttaaattaagtagctccaatctgaaactacatcttagaaatgttttaaggatattcaccaatgaaaaagagaataaagttccctctccccacttttattttccagcccacaaactcaatgctatcctccccgcaaaaaggacctttttttctgaccagacgaacactgtaatttttaaggtttctaagtaataaaaataggaagaaaacattaccccccaaaattggtttacacttagaagatgtttcccactgagcaaaggattggtaaggaacataatattaaggcaaccacctaactgcattcttaagtagtaacaggtggtaactcacgatatggagctgatttcctttctctattcctgccatgccagagacctctagtagaacttctgaggttactgtattacaacccaggttcagagagatttagaggtaaaaccttaaacactggaaatatctttaaaagtagggctttgtgtaccaaatacattcgttaaaacctaggaaactataaaatgaaatccaatgtattgatctcaatccccttgcctgcttcctaaagaggacagaggccaccaacactggtgctcaacacttgctaagtcgaaacactcttacacaggtcctctgattcttaacgggttcagaacttctggttgcattccccatgcaacccctccaactctacagggagaatgctggaaaaactgtgtcactttggcttcctgtatattaatataagcactcttatccagcaatagcagctgaaacataaatgaagatgagaactcagcctacatgacctaagatttcccacaagtccagatatttaggttacacacactgcactattgtctgatttctcctctgcatcaatctggaagtccacagagcagattagcacccaacaatcttaactaagctagtatcctactctgaagaaaggcgaagctggtggagggtttccaagactccttatccttctctgtccttcctcccatcccctccttacgtcttttctgtttgtttttatttaattttttttttaatgtatttttagtcacaagaaaatcaaagaagccacctacttaagtcttaagctctgccctttgcttagtcctaatggagagttctttggccatctatgtacaagagattagaggagccaaagagactggagaaccacatcaatgggagctttttcatctaaaggtcatctgtccacactgtccaaatgaggtttaccctgtgaaataaaacttggtgtaagtgctacctgctgagaaaaatagtatgaaatgtcacacaaaggactggggtgcagcaggaggactctgaaagagtcatacgtgtaaaccagcaggtcttagaatgccctaatatactatatgaagtttcagagtaaacaaatggttaatgacacatcttttgtaacacatgaatcagctactgatttgcaagagtgggacacaccctagtacctatgactctaaagtacctgtttgaaaagtggacctagatgtttgaattgccaacccatcctaagaccggaacataattttacaactatgtaagttgccataatttaaagttaaaaagatcactgcctttcattataatggaagttaatttgagaacttcattaaaacattcacaccgataatcaaagaacagtagagatacaaagtaaaatatagccaatcaatcctaggaagcaaacacaagaggcaagagaaatggcaggtaaaggaagtgaagaatagcaaattcaaaaactacaatattcccaattctaaagaaaaatgaataaaatgaggctggtaatgaaaaaataacacatcttaccttaagaggcatccaagtagcattcatagtgtcaggatataaagacaatactcagaaatgagcaagaagtcttagtaattccctcggttaccaagtataagcaggtaggaaaatcttttgtttcgagaaggtatctgaaagagaggattttcatttagactaaaaaataatcaagacaatgcaaatagtttaagctacctgggcagggattttgaagtactatttgcctcatcgcactaaaaaagtatagaaaatacagtcccctttagaaaagggcaaatgtgtgtctccatatatatgtgtgtagaaacatactttacataaaaagagaaataaatatgtaacacgtattttagataatgtaaaattgcttatcaaacaattagccaaaatcccagagagaataaagtaattttccagggtacttcataaacactaaacgtgatttgttaactaaccgtctaaagaaagacccttgccacatttaattatatttagtaaagtaaaacttctctaatcatcccgactgtcccaagattatgcttaagtttcagagtcaattccacatgaaaagtaaaacctattcttgactgaagtactagaaacaaataaaagacccttcttccccagagatcgttaaaagcagaccgagcaacttaattttgagggtgggaggaaggtaaatttgcctggaggcaggaggatggactaaatgacctctggtaggatcctcgttcaagtcctgggcctgtatacaattccagcttaaccagttactgcttcgcttaaaatggaggcttgcctgcgtagggacaaaaataacagcacccacttcttaaaaataaatgtcgaaaagtacccctttttaaataaaaataaaaaataaacacctctggagtggatgtgttcttgctatgcgtttgtcactgaggcttcgaagacttggcatcactttccttaccgctcaccggattttgggggaggagcggggggcgacagtttgactcttgacccaagtctcaggcggacttcagagccccacaggggcccccaactccagagccagagggagcggagaggcgagagcccgagatcgcacctccccccaccgcggaccccagtcccaaacccacccctcacctccccgcagtggggcgcctccttctgccccattcccattgttagggagggcagagcgcggggtgggctcagggcaggggcgcccgcggccgttgcccggctcgcttcaggaggggcgccccgcgggatgcggcttcccttcctctccgcgtcggtccgtcccacctcggctcggcctggcgccccgaggtccgctccgcgcccccggccgcggccccggcccgccccccgggcagccaggccctcaggccagtcggccggcagccggcgtcccaggcctacgagtgggcgctgggcgggggtccccgtgccccacacacgcgtcccctctcccccagccccgccgcttccagggccctcggcggcgcccgctccccgggccccgcggccccccgcctcccagccgggccgctccctcgagctcgtcgggtcagggacacctcctctacctcaccatcaccctggcccactcgtgcccccacccccaggggcaccagtgccaaaggcagctcccccagccccggacctacctgcacggttcaaccaagcctagaagtgggggcggggaatcttccgccctcctctggcgcccattggcccttcaggggcacatcgtgagcgccattggctgagcaatggtgtccgtcagagcgatggggcgggacagaagggggagagggatgctggtgccttggcgtctctgtctctgtgtatctcgttgtctctgtctctgtctcggcccttggaaacgagaggcttttggctgagaggactagaagggggcctgaggtgggaggaataggaataggaatcctgacagagcgtcacgccagttggccactctgaacgccctacctaagtcccctttaggttctcttctccatcacccccaacccctgcccctcacccctcgaggttctttcatccaggaagcgacgtgatgaaaactccaggccggaaggccatagggagagatgttatatatgtatataaaatatacacataaaaatgtttatatataaactcaaccagatatcagttcactagggcctggaaaggaaagggcacacatctcacagacagggaaggacttgagatagagccggtagaagaaggaatcaaaaatcactctaagagctggcaacagtggttacctcctgggagaggaactgagtgcctagggaaccagtgggcggaagacttacatatctcggcatatcatttgtatccattgatttttgcaccattcatcaagattccaatttaaagaaaaggatttaaatgtttaaataaggtcgcaaaaccaggggacagacaagataattgggcaggaaaattggcgcaacatgcagatttggggaggaatcttagcttttaatatgttcagctcccggtaacagggttttgtaaaacccagtgaaggtgtcccagaggcaactgaagttatggaacttgagagagggtagacaatcaggactagagaagatgcagggtcctctgcctaaagatagtgatctatgacatgctaaaggataaactcccaaagaagggtaataagacacccacagtaaaaggtaggaggacgaaaaagaaggtcagtgaggtaaaagaaacaatattaaagaggcatgaaaattaagggaggaagggtctgtggaaaatagaataataaaactatgagagaggccgggcacggtggctcacacctgtaatcccagcactttgggaggccaaggcgggtggatcacctgaggtcaggagttcgagaccagcctgcgcagcatggtgaaacccgatctctaatagaaatgcaaaaaaaaaattagccaagcgtggtggcgcgcctctgtaatcccagctactggaaaggctgaggtgggagaattgcttgaaccgggaggcggaggctgcagtgagccaagatcgcgccactgcactccagcctgggcgacacagtgagaccctgtttcaaaaaaaaaaaaaaaaaaaaaaaaacaacaaacaaactgtgagagcctcataggtcttacctctttacctctttaggctctggtaaccatgggacaataagaatgaaagccaaggccgggcacggtggctcacgcctgtaatcccagcattttgggaggccaaggtgggcggatcacaaggtcaggagatcaagaccatcctggccaacatggtgaaaccacgggcatggtggcgcatgcctgtaatcccagctactcgggaggctgaggcaggagaattgcttgaaccagggagtcagaggttccagtgagccgatatcacgccactgcactccagcctggatgacagagtgagactccgactcaaaaaaaaaaaaaaaaaaaaaaaaaacaacacctttatcgattaagaatcttttttctgagtttattaattctatttaaatcaaccccagaaaacaccttcaacacagcctctcatttcatatctgtaaaatggggcaaaaaaaaaaatagttcctaccctttagagttgttgtgaagattaaattagtgaatacatatgatggatttttttttcttttttcttttttatgagacacagtctcgctctgtctcccaggctggagtgcagtggcactatctcagctcactgcaagctccgccttccgggttcacgccattctcctgcctcagcctcctgagtagctgggactacaggcgtccgccagcatgcccgactaattttttgttatttttagtagatacggggtttcaccgtgttagccaggatggtctcaatctcctgacctcgtgatccgcccgacttggcctcccaagtgctgggattacaggcatgagccatggcgcccggcctgtgtgatggattttttaagagcctgactggcggggtgaggtggctcatgactgtaatcgcagcactttgagaggctgaggcaggtgaatcacttgaagccaggagttcgagaccagcctgggcaacatggcgagacctcgtctctacaaaaacacacacacaaaaattagctgggtatgatggtgcatgcctgtagtcccagctactcaggagactgaggtgagggtcgcttgagcctgggaggcagaggttgcagtcagccgagatctcaccactgcatttcagcctgggtgacagtgtaagaacctgtcaaaacaacaacaacaaaaaaaacaaaacaacaacaacaaaaaaacgcacgaaaaaaaccacataagctccttgagggcagaaactgtcccctagtcttctatattttatttcacacaatgtacagaagactaaatgaataattgttagctggtttttttttttaaaggggataagatcagttacaatgtctttttcctcagtcaatcacataagtatctaaaatgacattccaaagtaaggacaggagtttaaatcctgaactatggtatctaaagtaaacttgaactttccttatttttaaaaaattttggccgggcgcggtggctcacgcctgtaatcccagcactttgggaagctgaggcgggcagatcacaaggtcaagagatctagaccatccttgccaacatggtgaaaccccatctccactaaaaatacaaaaattagctgggcgtggtggcacggacctgtagtcctagctacttgggaggctgaggcaggagaaccgcttgaacccgggaggaggagactgcagtgagccgagatcacgccactgcactccagactggcgacagactgtctcaaaaaaaaaaaaaaaagaaaaagaaaaaagaaaagaaaaaaattccatacatagaattctgtgtggcattttagagaaaatcatggtgactagagacaccaggtgaaatttttttttttttttttttggtgacacaaccccaggagatcctgtgaacatgtgtcccttgaccaggtgaatttcaggagcttgcactagtcccaggttagctggcaccaggttggccctagtttgagtgccttccacataccaggtactgtgctggagaagtaacatcaaaaaggaaaatcaaatttcatcttcaataagcaatcacaatacactgtgatgagagttagggtgaaggaggttcaggttaccatgggcttatattaggagggcaaattctgtcttcaagtctttttgcttcaacagtagcgtttagatcttgtgggctgggcatggtggctctagcctgaaatcccagcactttgggagggtgaagtgggcagactgcttgagcccaggagttgcagattagcctggcaacatggcgaaaccccgtctctacaaaaaatacaaaagtcagccaggcatagtggtgcctgcctgtagtttcagctacttgggaggctgaggtaggaggatcgcttgaccccaggagttcaaggctgcagtgagctaccatcgagccacttcacttcagcctgggccgcagaataagaccctgtctgaaaaaaaaaatcttgtgatataataacagcttgtgcactcttcgatagctcagctggtagagcagagggctgtagactgcatagataataataacagtttgcgtttttgagtcaaagatgataccccagaatcattatcgaaaataatggttgatccattcacctgtgcctatgactgtgagccacattgtgaccaatctgtgagcaacatgggtgggaatgcagtttggggccatggaactcacttaacaggaagttccaatagcagtggatttaccatgttgcggctgtaggatcttggacaaatatttaatgacctctgtctctcagttctctcaataataaaacatccctccgagagttgctgtaaaggttaacatagggggagtcttgcaaatagtaggtgctaaaatcctgtcttgaaaaaaaaaaaaaaatatatatatatatatatatatatatatatatatgaagagatgagatcttcaattgtacagactgtccctgtacccattcatttgcatttcttttcctttacaataatacatatctatgatttcctttcattcccactgtcatcaatttagttagattactgggcagagatcaccagtggggctagagtaaaatgaaaataaatgtacattgactctaggtattcctaagtaatagcacagtttactgtgttctccctcataaatcctggtagctgaatgttgcctgcttttagcagttacgtttctgctcatctcaccctcaatgttcattaagaaaatagttattgaatggccaggctcactggctcacgcctgtaatctattacaggcgtgagccaccgtacccagccttggttatcatatttctaatttataatagtttttcttgttttcttattgttcattttttatagcatcctgttcttatattatggatatatatcttcaggtctcgctgaagaaataaagaggtgtatgtgtatatatgtgtgtgtgtattatctttatttttattttttgagatggaatcttactctgtcgcccaggctgtagtgcagtggcgcttttgggaggctgaggtggaaggatcacttaaggccaatatttggagaccagccagggcaacataacaagacccccatctctacaaaaaaattaaaaattagctggccatggtggtgagtgcctgtagtctcagctacttgggaggctgaggcaggaggattgcttgagcccaggaggttgaggggggaggtgagccatgattgagccactgcactccagcctaggtgacagagtgagaccccatctctaaaaaaaaagagagagagaaataaaatagttattgagcacctactgtatgtcaggtccaagaccctaaagatgtaaagatgaataaggtggtgaccctgccttccagtttccacaaaggtggggaatatggataaaagcagacaaagccattgccatgggataagggcagagaatagcatgtgcaaattatagaaggtgagggataatataccactttccagaaactgatggttcaatgaggctaaagcatggagttcaagaaaggaaaccagatgagattaactgcaatgtggttctcaaacttaaatgtgcataaaaactggccttgttgactgggcacagtgactcacaccggtaatccaagcactttgggaggtcgaggcgggcggatcgcttgaggtcaggagttcgaaactagcctggccaatgtggtgaaaccccatttctttttttttctttttcttttttttttttttttttttttgagacagagtctcgctgtcgtccaggctggagtgcagtggcgtgatctcggctcaccgcaagctccgcctcctgggttcacgccattctcctacctcagcctcccgagtagctgggactacaggcacccgctaccatgcccggctaatttttttgtatttttagtagagacggggtttcaccatgttagccaggatggtctcgatctcctgacctcgtgatccgtccgccttggcctcccaaagtgctgggattacaggcgtgagccaccgcgcccggcctgaaaccccatttctactaaaaatgcaaaaattagctgggtgtggtggtgcacacctatagtcccagctgctcaggaggttgaggcgggagaatcacttcaacctgggaggtggagatggagtaagccaagatcaagccactgcactccagcctgagtgacacagcgagactctgtctccaaaaaacaaacaaacgaacaaaaaactggccttgtttacatagtctcgcaagctccaagcctagagatcttgatggagcgggtcagagtgctgctgctcggagggctacactctgagaaccaccgatggagaagaagggcggggtcaacttgcagagctgtgctgggaggtgtgtgctgcagccttgagggggtgaagaacctttgagaggttttaagcctgcaagagatgtggtcacatttatattttagaaaaatcaccctgtgtgcaatatgaaaaatgaaacagagagggcaagactggagtcagggagagcagttaggaggctgctgcagaaacccaggcaagaaatcataaagacctgaaataaaacaatgccagtggggaacggggaagagaggccaaatccaaggggtatttaggagccagaattgagagggtgtgatgagtgttgatgggatacaggacaggatcctgagatggcttgcaggtcttcagctttgagtgacccatggaagcgaaggaagatgggaaggagggtgcctatcacacagagagaatgaaggtttgagaggcaagtgtagcttttgacattttgcttttgaaatgtctatgggacatcagaaataatctcaaaagaccacaagtcaggcagggcgcggtggctcacgcttgtaattccagcactttgggaggccgaggtgggcagatcacgaagtcaggagctcaagaccagcctggccaacatggtgaaaccccgtctctactaaaaattcaaaaattagctgggcatggtggcgggcacctgtaatcccagctacttgggaggctgaggcaggagaatcacttgaacctgggaggcggaggttgcaatgagctgggatcgagccatcgcactccagcctgggcaacaagagtaaaactctgcctaaaaaaaaaaaaaaaccatgagtcactggttaacagcctgagcggcagaaatctcacagttctgagtctgaatcctatctagcctggctctgaaactcacaatctggagctggggcttggtgcagtggctcaggcctgtaatcccagcactgtgggaggctgaggcaggtggattgcttgaggccaggagtttgagagcagcctggccaacatggtgaaaccccatctctactaaaaatacagttagccaggcatgatggtgtgcacctgtaatcccagctacttgggaggctgaggcacgacaatcgctggagcccaggaggcagacgttgcagtgagccgagattgtgctactgcactccagcctgggcaacacagcaacactgtctaaaaaaaaaaaaaaaaatgctgggcgcggtggtttacgtctgtaatcccacttttagaggctgaggtgggaggatcacctgaagccaggagctcaagaccagcctggccaacatggtaaaacccgccatcccctccctgccatgccccatctcccccaacactctcccaccctgtctctactaaaaatacaaaaattagccgggtgtggtggcacacacctataatctcagctacatgggaggctgaggcataagaattgcttgagcccggaaggtggaggttgcagtgagccaagatcgcaccactgcactccagcctgggtgacagagcaagactctctcttaaaaaaaaaaaaaaaaagaattttttttttaaatatagagatgggctttctgtgtttcccaggctatactcaagctcctgggctcaagctattctcctgcctctgccttcaaccagcctcaatcctccaattttcttattttttatatttttcaacaccttttaaattctacattctggccagctgcagtggctcatgcctataatccagcactttgagaggttgagatatgagacttgcttgaggccaggagtttgaggcttgcagtaagctagaatggcgccacggcacagcagcttgggagacagagcaagaccttgtctcaaaagaaaaagaatttaaatactacattctaggagatttcttcaaccttcaaattttgtattgaatttttaattttggcttttatttatttattttttttttgagacaggttctcactctgtcacccaggttggaatgcggtggcttgatctcagctcactgcaacctctgcctcctgggttcaagtgattctcctgcctcagcctcctgagtagctgggattgcaggcgtggtccagcatgcccagcttatttttgtattttcagtagagacggggtttcaccatattggccaggttggtctcaaactcctggcctcaagtgatccacatgcctcagcctcccaaggtgctgagattacaggtgtgagccactgcacccagccttggctatcatatttctaatttatgatagtttttcttgctttcttattgttcattttttatagcatcctgttcttatgttatggatatatatcttcaggtctcgctgaagaaataaagaggtgtatgtgtatatgtgtgtgtgtattatttttatttttattttttgagacggagtctcactctgttgcccaggctggagtgcagtggcacaatcccagctggctgcaacctctgcttcccaggttcaactgatcctcccacctcaatctcccaagtagctgggattacaggcacctgtcaccatgcccggctaatttttctttctttgtttcttttttttttttttttttttttttttgagatagagtctctgttgcccaggacggagtgcagtggtgtgatctcggctcactgcaagctccacctcctgggttcaagagattctcctgcctcagcctcccaagtagctgggattacaagcgtgtgccaccacacccagctaatttttgtatttttagtagagatggggtttcaccatgttgtccaggctgatctcaaactcctgacctcaaatgatccaccttcttcagcccgccaaagtgctgggattacatgcatgagccaccacaccagcaaaatttttgtatttttagtagagatagggtttcgccatatgtgtgtgtgttttaagtttttctgttttcatttctcttggcatatatacctcggaatggaattactgggtcatatgggagctctgtgttaaacacttgtgtcatatctaagaaaacttgctaatccaaaggtcataaagatgtatgtctatgttttcctctaaggccaacatggtgaaacactgtctctattaaaaaaataaaaactgggccgggcatggttgctcatgcctgtaatcccagcactttgggaggccaaggtgggtggatcacctgtggtcgggagttcgaggccagcctgatcaacatgcagaaaccccgtctctactaaaaatacaaaaaaattagcagggcatggtggcgcatgcctgtaatctcagctacttgggagctgaggcaggagaatcgcttgaacgcaggaggcagaggttgcggtgagccaagatcgtgccattgcactccagcctgggcaacaagagcaaaactcggtctcaaaaaaaaaaaaaaaaattagttgggcgtggtggcgcgcacctgtagtcccagctactccagaggctgaggcaggagaatggcttgaacccaggaggtggaggttgcagtgagctgagatcatgccactgcactccagcctggcaacagagcaacagagcaagactccatctaaaaacaaaaaaaagagttttctacttttcagtctaacaaatgttttataaacaaaggctttgttatattttgagttaatttttatagataatatgaggtgaggtttcaacttcattctattgtgtgtgggtatccagttgtcccaggaccattgtttgaaaagacttttttttctacactttctctcattgaattgtcttggcatatttgttaaaaatcagttgaccttggctgggcaccatggttcacacctgtaatcccagtattttgggaggccaaggcaagaagaccatttgagcccagaagttcaaaacccgcctgggcaatataggcacactccatttctaaaaataattattaaaaagattagctgggcaggccagacatggtggctcacgcctgtaatcccagcactttgggaggccaatgcaggtggatcacctgaggtcagaagttcaagaccagcctgaccaacatggagaaaccccatttctgctaaaaatacaaaattagtctggagtggtgactcatgcctgtaaatcccagctactagggaggctgaggcagaagaattgcttgaacccagaaggcggaggttgtggtgagccgagattgcgccattgcactccagcctgggcaacaagaatgaaactctgtctcaaaaaaaaaaagattagctgggcgtggtggcacatgcctgtggtcccagtgacttaggaggctgaggcagggggatcgggagacggaggctgcagtgagccttgatcactgcactccagcctgggtgacagagtgagaccctgtctcaaaaaagaaaaaaaatcagttgaccgtaatgtgagcactcatttctggactttcaattctattccattgatctatatgtcagtccttatgccagtgcccaggggctcaactactggtactgtgaattagattttgaatcaagaagcgtgagtcttccaattttgttcttatttttcaagattgttttgtctatttgaagttccttacaatttaatgtgaattttagaatcagcttgtccatttttgcaaaaaaggtagttgggattttgatagagattgtgttgagtctgtagatcaatttgggaggcattgctatgtgaagagtagtaagtgtttcaatccatgaacacacaatgtcttttcatgtatttaagtttaatttctttcaataatgttttgtagtttgcacttccttggttaaattcattcctaagttttttttggtgccattacaaatggaattgttttattaatttcatttttggattgttcatttctagtgtatagaaattcaactgagccaggtgtagtggtgcaccacctgtagtcccagctacttgggaggctgagtcaggaggattgcttgtggccatgtttgaggctatagtgcattataattgtgcctgtaaatgatcactgcattctagcctcggcaacatagtgcagtcttgtctcttaaaaaataaataaataaacaactgatttttgtacgttgatcttgtatcctccaactttgcaaaattaatttattactattaagactttgtggctgggcacggtggctcatgcctgtaatcccagcactttgggaggccaaggcgggcagatcacgaggtcaggagatcgagaccatcctggccaacacggtgaaaccccgtctctactaaaaatacaaaaaattagccaggcgcggtggcaggcacctgtagtcccagctacttgggaggctgaggcaggagaatggtgtgaacccgggtggcagagcttgcagtgagccaagatagcgccactgcagtccagcctgggcaaaagagtgagactccgtctcaaaaaaaaaaaaaaaaaaaagattttgctttattttgtgtttggtgtggatactttaggaaccaaaagataaataaataagaacaaggtctagcactttggtcaaatttattcctaagtgtgtgtttgtaaacgatattgtaaatgaattttcttagtttcattttcagcttgctaattgttactgtatagaaatacaatttatttatttatttactttttttttttttttttgagacagtctcgctctgttacccaggctggagtgcagtggtgtgatctcggctcactgcaacctctgcctcctgggttcaagcaattctcttgcctcagtctcccgaacagctgtgattacaggtgcgtgccgcaacccccagctaatttttgtatttttagtagagatgggttttcaccatgttggtcaggttagtctcaagatgttcttttttttttttttttttatcattttatttatttattttttaatttttatttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcctgcctttctattccacaaagccgccattgtcatcctggcccattctcaatgagctgttgggcacacctcccagacggggtggtggccgggcagaggggctcctcacttcccagtaggggcggccgggcagaggcgcccctcacctcccggacggggcggctggccgggcgggggggctgaccccccccccaccggtcaggttagtctcgaactcctgacctcatgatctgctcacctaggcctcccaaagtgctgggattataggcatgagccactgcgccaggccaattttttttatatcactcttacacctgcaactttgctgaatttgtttacttgttctgacggttttgtggattccttagaatttcctacatacaagatcatgtcatatgcaaatacatatggttttatttcttcctttctaatttgtgtggcttttatttctttttcttgctaatttcctggctagaaatttaagtataatgttgaatagaggtggcaagagtgaatatccttgtcttcttcctgatcttaggagaaaaacttatagtctttcatcattaagtattacctgtggggctggatgcgatggctcaagcctataatcacagcactttgggaggccaaggcgggtggatcatttgaggtcaggtgttcaagaccagcctggccaagatggtgaaacccccatctctactaaaaacatctctactaaaaatataaaaacttggcggggtgcagtggctcacacctgtaatctcaccactttaggaggccgaggcgggcagatcacgaggtcaggagatcaagaccatcccggctaacacagtgaaacccatctctactaaaaatacaaaaaaaaaaaaaagaaaattagctaggtgtcgtggcacacgcctgtagtcccagctacttgggaggctgaggcaggagaatcgcttgaacccgggagacagaggttgcagtgagccgagatcacaccactgcgctccagcctgggcgacagagcaagactccatctcaaaaaaaaaaataaacgtaaattagacaggcatggtggtgcgcacctgtagtcctagctactcaggaggctgaggaaggagaattgcttgaacctgggaggcagaggttgcagtgagtcgagagcatgccactgcactccagccagggtgacagagtaagactctgtctcaaaaaaaaaaaaaaggatttatgggaagtaattaaggtcaaatgaggtcataaagctgggcactgatctaatagaattagtgtctttatgagacgagaacccagagagctccctagctttctctctgccacatgaggccacttcaagaaggcaagccaggtaataaagcccacgctgaggtaggaggtggaactggactccagagatggggcttggacaccagaccaaattgatgactagctgaaacagggacagggtgaaagcagctttccataagacacgctcaaccagtgcaccatgtcagcttaccatttccatggcagaacccagagttaccaccccaccgccttttttttgagacggagtctcactctgtcgcccaggctggagtgcagtggcacagtcttggctcactgcaagctccacctcccgggttcaagcgattctcctgccttagcctcccgagtagctgggattacaggcgcctgccaccgcgccaaactgatttttgtatttttagtagagacagtgtttcaccatcttggccaggctggtcttgaacttttgacctcatgatccacctgccttggcctcccaaagtgctggaattacaggcctgagccactgtgctcagcctaccacccctttcaatggcaacaacttgacaacccagaagttatcagcctttttctagaaacgtctgtatagtctgccccttaatttgcatgtaattaaaggtcaatgtaaatatgactgcagaactgccctgagctgctactctggtcacactacctacagggtagccctgctctgcaaggagcagtccctctgctgttgctataggccactgcttcaataaaagttggcatctaggccaggtgcagtgggtaatgcctgtaatcccagcactctaggaggctgaggcgggtggatcatttgaggccaggagtttgagaccagcctggtcaacatggtgaaaccccatctctactaaaaatacaaaaaaattagttgggtgttttggcgcacacctgcactcccagctactcaggaggttgaggcgggagaatcacttgaacccaggaggcagagtctgcagtgagccactgcactccagcctgggtgacagagtgagaccctgtcccgaaaaaaaaaaaagttggcctctaacaccttcggtttgcccttgaattatttcctgggtgaagccaagaaccctctcagtctaagccccagttttgtggcttacctgccctgcatcaacaccagaaacttaaccctttgggaatctcgatcttggactttctagcctctagaaccatgagaaaatgatctgtattattaggctacccagtctatgatattctgttgtagcctggggtgactaagacattgagcctgtatgacttgaattttgttacctgcttggccccttgatggcatttcagtttgtgactcttggtttacgtgatcacgaagccaaaactgtttaggaaggaagcaaaatcaagacagattaaaaataaaaataaaaaataaaaggctgggcaccgtggctcacgccctcccagcacgttgggaggcaaaggtaggcagataacttgaggtcagcagttcaagaccagcctggccaacatgatgaaaccacatctctactaaaactacaaaaattagccaggcgtggtggtgggcacctgtaatcccaggtatttgagagggaggcaggagaatcacttgaacctgggaggtggaggttgcagtgagccgagatcacaccactgcactccagcctgggtgacagagcaagactctctctcaaaaaataaaataaaataaaataaaataaaataaaataaaataaaataaagagccgagcacgctggctcacacctgtaatcccacacttcgggagaaagaggtggcaggattgcttgagcccaggagtttgataccagcctaggtaacatggcaaaatcccatctcaattttaaaaaaattttaaaaaagaataatagggctgggcacgatggctcatgcctgtaatcccagcactttgggaggccaagatggatggatcacctgaggttgggagtttgcgaccagcctgaccaacatggagaaaccccatctccactaaaaatacaatattagcaggtcgtggtggcacatacctgtaatcccagctactcggaaggctgaggcaggagaatcgcttgaacctgggaggtggaggttgtggtgagccaagatcgtgccattgcactccagcttgggcaacaagagtgaaattccatctaaaaaaaaaaaaagaaagaaagaaataaggtattttacataaagattaaaaagaaattaaaaccattatttgaagataatggcttaaacagaaactctgcaaatccttagaataagaaagttcaggccaggtgtagtggcttgtgcctgtaatcccaatgcattgggaggctaaggtcggaggattgcttgagcccaggagtttgagacaagccgggtcaacataatgagatcgcatctctacaaaaaattgaaaaatgagccaggtgtggcagtgcgtgcctgtagtcctggctactcaggaggctgaggtgggaaggtcacttgagcctgaagagttcaaggctacagtgttatgatcatgccactgcactgcactccagcctgggagacagagcaagaccctgagaccctgtctcaaaaaacaaaataaaaaaccctcactatattgaacacaacatcaatgttcaatagccactctccttctccttttctaataaaattccacttttttgtgttccatcccaggaccacgatttatctaaactggtcattctggatcaataagtttggctaaaaataaataatatcgaaattggtcacaggaaatctattcttttttttttttttttttttttttttcagacaaagtctcactctgtcgcccaggctggagtgcagcagcatgatcttggctcactgcaacctctgcctcccgggttcaagcaattctctgcctcagcctcccaagtagctgggattacaggtgcctgccaccacgcctggctagtttttgtatttttagtagagatggggtttcaccatcttggccaggctggtcttgaactcctgaccttgcgttctacctgccttggcttcccaaagtgctgggtctgtcacccaggctggagtgcaatggtgcaatcatggctcactgcagcctcaacctccctgggctcagatgattctcccaccttagcctctcaagtagctgggattaaaggcatatgccaccatgcccagctaatttttctattttttttgtagagacagggcatccctaccttgcccaggctggtcttcaactcctggtttcaaaggatcctcctgcttcagcctcccaaagcactgggtctattattccctttcatattcaaacttaattctgcattttcaaggccttgaattttcaagggcagctttttctgtccctgaacttaatcttcagctcctctcacctcctgggaggttggggggtggggaagaaaagtcccaaccctctaatcctgctttggtcttttgccgccagcccccatcctgaagctaccagtcaatttgtttgcatacaagaagatatcactttggagattctaagtgtatacgaggaaatgaggtcaaagaccaaatatatatatttcactatatcacacttcaaacttttgtttactgtttcccttctcctactctattataaacctttgagggtggggactgtgagttatttatctttatattcccagtgtcaagagtgtttagctataatgggaatgaatctcaaagtttcttgaataaatgacaagaagaatcatagttgcatgaactaaattcattattctcagtccttgaggtaaatgaatatattgatattatgtctgcttactctttttttgcgagagagagaaagaggagggagggagggaaggaaggaaaaaaggaaggaaggcgaaaagagtgaaagaaaagagagagaaaaagagagagaaagaaggaaggggagggaaggaaggaaaagaaggagggaagaagggaaagggagggagaggaagaaaagaaagaagaaggaaggaaagaaagaaagaagaaaaggagggaggaaggaacgaagaaagggaaagaaggagggagggagggaaatgaaggaaagaaagaaaaaagaaagaaagaaaaaagaaaagaaaaggagggaggaaggaaggagggagggaaggatggaagaaagggaaagaaggagggaggaagggacatgaagagaataaagaaagaaagaagaaaagaaaagaaaaaagaaaagaaaagggagggctctgcgggcggcggcggcgcggggagccggttgcaggccgagatgctgcagatggacctgatcgacgcgacgggggacactcccggggccgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgcagttgtctcaggacacactgaataataattctctgggcaaaaagtacagttggcaggatcgggtgtctcgatcatcctcacccctgaagacaggggagcagacaccaccgcatgaacccatttgcctgagcgatgagctgcccccccagagcagccccgcccccaccacagatcgaggcacctccaccaacagcccacgctgctggagctggtgagcctgcggccgtgcttcagagactacagtgacgagagtgactcggccatcgtctacgacaactgtgcctccgtctcctcgccctatgagtcagccatcggagaggaatatgaggaggcctcccggccccagcctcctgcctgcctctccaaggactccacgcctgacgaacccgacgtccatttctccaagaagttcctgaacatcttcatgagtggccgctcccgctcctccagtgccgagtccttcgggctgttctcctgcatcatcaaccgggaggagcaggagcagacccaccggaccatattcaggtttgtgcctcgacacgaagacgaacctgagctggaagtggatgaccctctgctagtggagctccaggctgaagactactggtacgaggcctacaacatgcgcactggtgcccggggcatctttactgcctattacgccatcgaggtcaccaaggagcccgagcacatggcagccctggctaaaaacagtgactgggtggaccagttccgggtgaagttcctgggctcagtccaggttccctatcacaagggcgatgtcgtcctctctgccgctatgcaaaagattgccaccacccgccggctaaccgtgcactttaacccgccctccagctgtgtcctggagatcagcgtgcggggtgtgaagataggtatcaaggccgatgactcccaggaggccaaggggaataaatgtagccactttttccagttaaaaaacatctctttccgcggatatcatccaaagaacaacaagtactttgggttcatcaccaagcacctcgccgaccaccggtttgcctgccacgtctttgtgtctgaagactccaccaaagccctggcagagtccgtggggagagcattccagcagtttcacaagcagtttgtggagtacacctgccccacagaaaatatctacctggagtagccgcgcagccccgccctctgcgtcccccggccctcaggccagtgccaggacagctggctgctgacaggatgtggcactgcttgaggaggggcacctgccaccgccaggggatgaggaagtgggggccgctggctcagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccatacctcccctgccagggctcgggtgctctggctcctgccttgatgaagcccatgtcctgccttgatgaagcctgtgccacctgcaagtgcccgccctgcccctgtcccaacacccaccgaagagccctgagctcaggctgagcccagccacctcccaaggactttccagtgaggaaatggcaacacatggaagtgaagtccctgttctcagctctgtcatctgcagggcttctgggtggctcctgccactgacctcactggcatgctagcctgtggcaggcctaggacctcagcggggaggaggagctgctgcaaggccctatcccagcaggagagggaggcttcctgactgacacaggctagccccatcttggtcctgtcaccctggccccaactattaaagtgccatttcctgtcaaaaaaaaaaaaaaagaaaagaaaagaaaagggagggagggagggaggcaggaaggaaggaagagagggagggagggaagggaggaagaaagggaaagaaggagggagggagggaaatagaaagaaagaaggaaagaaaaagaaagaaagaaagagaaataaaataaaaattaaaaaaccataaggttaaagtaaaccctttttcttcatacagattaaaacacatgacttcaaattacagctttgcttcttaatagcttggtgatgtaggacgttatgtaacctctctgtgcctcagtttcctcatttataaaatagggcaataataatatctagcccataaggcattgtgaggattaaatgtgaaatgctgatcacaaatacctagcagcccaatagatactcactgtaataattattatttttataatttctgcaaaagtatggtgatgattcttgggttaacctaaaggcagattttcttttatttcttcctgtttcttttcttttccttgttcactttaaagaattaaaaagaaaattgattccagcattttggaataaaaatttgcatcaaaaagaatttattcattttattgacatacaaataaaatgtcatttgtttattcaataaacatttattaaatgtctggtaaatttcagacatcatgccaggcacagggatgacaatgacaataagatgtggtctctgccctcagggagctgatagtccaggagactgacaagtagacaggtgattacatgcaatgtaacaaaggctatgatgtcatacaagaagacaagtgggagtatgtgatgggagtatggttttgaccagttcctcctcttagatttatccctttttctttggctataaagcaaaagaattggtcctatttttttttcttaactttgcaaattaaaccataaattttaataactttataaagataaaaggcaagcggtcagattcagtggctcacacctataatcccaacactttgggaggccgaggcaggtggataacctgagatcaggagttcgagaccagcctggccaacatcgcgaaaccctgtctctactaaaaatacaaaaattagctaggtgtggtggcaggcacctgtaatcccagctactcaggaggctgaggcaggagaatcgcttgaacctgggaggcggagtttgcagtgagatgagatggagccattgctctccagcctgggctacagagcaagactctgtctcaaaacaaaacaaaacaaaacaaaacaaaaagatgagcaacttgaattatggaggacactagaaatagtgtttcctacagaatcagggcttcctaccaacatagtcacttctagggttttcgacctgaaaagttctgtggcatattgtttctttgctatccacttttttttccctatttttccccctctttctctcctctactttatctcctagagatctaggtagttcccaaaggaataatgctttacggagtctaatgttgatttattaggtaaaaacagaaaatgacttttttttttacccacaagttccataccaaaaaatgaatgtaaacttcttatgcagtttcacacattgaaaatgcaggttattttaattccattgcatttttcagaattctcaatcgcaatcctctgacaactgttgaagatccgtatctctttaaattactggcattaaaatatctgtaagtactatagtactcttgggagtcatgagatgatttatactctttttaaatttttcatcaaagattaagtattttgcatttaggctaaaatgtcataatttaaattttaactgagttattgaaaaacattattggcaaaggaaaggatgtgtaatggtcaagatagccagcaggggaaagagaacagtgttgaagaacccatatagatttggaacatgtagacacatggaggaatattacttaaccaagaaagcaaaggggaaaaggtgttcattattctaaaaaggaagaaaagagtaaataatcaagatgggtgaatgcaatatgaaaatgagaagtaagataatggtaaaaaaaaaaaacagtgtaagacctactcttgaatatcattaatttgatgatgcaaatcaactttaatttctttaataagagctctctggaattttgcggcaaataaactgttgaactggcttgttttatagggaagccaaaattgaagtaatcacatgtccttgaattatctttttaagtacagaattttttactggggttcatatcatgaatgtttcggctttcttcttcagagacgtgggaacaacgcaagtcccacttacaacacttaagaacattctcatgatgaccgttgaactggaaaaactgtaagttatttttttcttagacttattttcaccctgttgcgtttttaggtttgttttattattttcttaagtcaggtttattgagatataattttcatatactaacattcaccctttttaagtgtacaatttgatgagttttgacaaatgtatagttacataaccaccaccacattcccaatataaagcatttctgtcgcctcaaaaaggtccctcgtgtccctttgtagtcaatcacctcctcccaccgtcagcccctgttagctactaatctgatttcctatagttttgccttttccagaatatcttataaatgaaatcatatagcatgtagcctcttgtatttgacttctttcacttagcataattttttcttttttgagatggagtctcactgttgcccaggctgcagtgcagcggcatgacctagactcactgcaacctccacctcccaggttcaagtgattctcctgcctcagcctcctgagtagctgggattacaggcacatgccaccacgcctggctaatttttgtatttttagtagagacgaggtttcaccatgttggccaggctggtttggaagtcctgacctcaagtgatccgcccgccttggcttcccaaagtgctaggattacacgtgtgagccacctcacctggcctcacttatcatattattttttgaaattatgctgccatccatgttgctgcacccatcactacagctggccctccatatctgcaggttcctcatccatggattcaactgaacatggatggagaatacttgaaaaaaatgaaatatataaaataactataagacaataaaaacagtagaaaatttaaaatacagtataattatttacataccatttacactgtattaggtatttaaagtatacctgaggctatatacaaacattatgtcatttcatagaaaagacttcagcatctgtggactttggtgtcggcagggggtcctggagccaatcccctgcagacaccgagggacaactgttcactcctttttattgctcagtagtattccagttgtgtggaaaccccatctctactaaaaatacacaaattagccagatgtggtggcacacacctgtaatctcagctactcaggaggctgaggcacaagaagtgcttgaagctgggaggtggaggttgcagagtctcctttacacttgctgtcctccctccactgccgcctgacacactcctccccagcagtggcctcttcataggcaaatttaaggagcaccttttagtccttgtcctgcttgacttggccctgatgtttgaaattcttgataaatctttcttccggaaacacactctttctatgcttccaggaaatctttttcttggttctccagacaacttcttagactccttgaccaattccttcttgttgccaacaatggaaacaaaccagccctacctaagcaaagcacattaaaactcactagaaagatacaggggagggggcgcccactaaaccactaaagagacaggaggtggggagctgtaggaccaggtttgggaacctgcaagaatcaagaccagagcccctgaaatagcaagaagctggaagcacaggaactgtcagagccagatggctgtcactgcagtcagcgcctctgattgtttgtttttgagatggagtctcgctctgtcgcccaggctggagtgcagtggcatgatctcggctcactgcaacctccacctcccgggttcaagcaattctcctgcctcagcctcccgagtaactgggactacaggagcctgccaccatgcccgactagttctttatatttttaatagagatggggtttcaccatgttcgtctcaaactcctgaccccaggcgatccacttgcctcggcctcccaaagtgctgggattacaggcgtgagccaccatgcctggccagtttttgtatatttagtagagactggttttgccatgttggccaggttggtctcaaactcctgacctcaagtgatccatccacctccgcctcccaaagtgctgggattataggcatgaaccactgtgcccagccacctctgatagttttcatcgtcctcgggccactggctcccaaatcacggttccagacaaaagcttacaagtagtccagctttggccaggctcagtgtgatggttaatactgagtgccaacttgattggattgaaggatacaaaatattgatcttgggtgtgtccgtgagggtgttcccaaaggagattaacatttgagtcagcgggctgagaaaggcagacccacccttaatctgggtgggcacaagctaatcagctgccagcaaggctagaatataagcaggcagaaaaatgtgagagactggcttagcctcccagccaacatcttcctcccgtgctggatgcttcttaccctccaacatcggactccaagttcttcagttttggaactcagactggctctccttgctcctcagcctgcagacggcctattgtgggaccttgtgatcctgtgagttaatacttaataaactcctgtatatattccattaattctgtccctctagagaaccctgactaatacgctcagtgactcacacctgtaatcccagtactttgggaggctcaggcaggaggatggcttgagccccagagtcttcttcttctccttctccttgtccttctcttcccttcccctttctcctcttcctcttccttctcttcctcttcctcttcctctccttcctcttcctcttcttcctcttgtttgtttgagaaaggttctccctctgttgccaaggctggattgtagtggcacaattgtgactcactgcttctcagcctcctgagagcccaggagtttgaggctgcagtgagctatgatcacactaccacactcctgcctgggtgacagagcaagaccctgtctcaaaaaacaaacaaaaaactctggtatgatagaggtgaattgtctgttttatcctgataattctgcttaccttagtcccgtggttctcaactgggccaattttgctccccaagtgacatttggcaatatctgggcagaggtcaaggacgctgcttaacatctttttttttttttttttgagacacagttttgctcttgttgcccaggctggagtgaaatggcacgatctcgcctcactgcaacctctgtctcccgggttcaagcgattctcctgcctcagcctcccgagtagctgggattatgggcatgcaccatcacgcctggctaattttgtatttttagtagagatggggtttctccatgttggtcaggctggtctcaaactcccaaccttaggtgatcagcccacctcagcctcccaaagtgctgggattacaggtgtgagccacctcacctgtcctgcttaacgtcttaaaacacacaggacaattcccccataaaaaatgatgaccagccgaaaatgtcaacagtatcaaggtgaagaaattgccataaaggcttggtaaacagggatggtatgacgacactattgataggccacattaaaatacttagggccatatccattatccctgtttttatgatttcttctttgtccccatgcagtttcaggggcaaaataagggagtaagtcagaggtggttccaaatagacatctgggaatcttagggtgtaatatggccctcatggaggcccttgctgagcttagggcctgattctggaatcctagcattgccaagagaggcaggctggcaggtgagaagacaaataatgggagagcccacatatgttggaattcatttgatggtatctaagctggggtgattgtccccactagcattacatgactatggatccagttatttggagaaatccatttcctccacagggaatatatactacattagaaccaaagatggaatccttagtaaatggaatcatttggcaaaattcagttgtctgaaatttttgcataaaattctcttttttattttcattgagccaaataaataaagtatcaggtatttactggggtcaccattctttgattcattgattttttttttcagacaggatctcgctgtcacccacgttggagtgcagtggcataatctcagttcactgcaacctccacttcctgggcttaagtgattctcccacctcagcctcccaagtagctggaaatacaggcgcgtgccaccatgcctccattttctttctttttttttttttttaattgatcattcttgggtgtttctcgcagagggggatttggcagggtcataggacaatagtggagggaaggtcggcagataaacaagtgaacaaaggtctctggttttcctaggcagaggaccctgcgccttccgcagtctttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtatagaacaaaatgaaaagtctcccatgtctacccgcctctacacagacacggcaaccatccgacttctcagtcctttccccacctttcccccctttctactccacaaaaccgccattgtcatcatggcccgttctcaatgagctgttgggtacacctcccggacggggcggctggccgggcggggggctgacccccccacctccctcccggacggggtggctgccgggcggagacgctcctcaattcccagacggggcgactgccgggcggaggggctcctcacttctcagacagggcggttgccgggcggaggggctcctcacttctcagacagggcggttgccgggcggagggtctcctcacttctcagatggggcggccgggcagagacgctcctcacctcccagatggggtcacggccgggcagaggcgctcctcacatcccagacggggcggcggggcagaggcgctccccacatctcagacgatgggcggccgggcagagacgctcctcacttcctagatgggatggcggccgggcagagacgctcctccctttccagactgggcagccaggcagagacgctcctcacttcccagacggggtggcggccgggcagaggctgcaatctcggcactttgggaggccaaggcaggcggctgggaggtggaggttgtagccagccgagatcacgccactgcactccagcctgggcaccactgagcactgagtgaacgagactccgtctgcaatcccggcacctcgggaggccgaggctggcggatcactcgcggttaggagctggagaccagcccggccaacgcagcgaaaccccgtctccaccaaaaaaatacgaaaaccagtcaggcgtggcggcgcgtgcctgcaatcgcaggcacttggtaggctgaggcaggagaatcaggcagggaggttgcagtgagccgagatggcggcagtacagtccagcatcagagggagaccgtggaaagagagggagagggagaccgtggggagagggagagggagggggaggggagggggagagggagagggagaggtgcattttcttataaacccaatttcctctttagtgcaactctaccatttgaaaggaacctttctattgtaatttacaagctgtgaataaccgctatgtaattctttccaaggattaataaactgagagaggatttgaaccaacagaggtaggggaagattagaagggggatgcaagtggccacagatcttagaggcggccagcagagggcgctgctccaaggtgaaggtcgcaccctgagaggccatccttttttgtaggaccagactggggtgtaaggacagtgcctcatcctcacaacgacagacccgtgttctgggtgtggatttgcctcccttgcctgcgggacttctgctagcactgccgttcctagacttagaccatgctagaatgagtccaggaaccgaggagaggagatgggagtggctcctcccactgtggcccctaataattcacatgaagaatttttgctttccttgccagggacccgggactcagtgggtccagaggtcctagtgccaaaggaagaaatgtgtagatcaggaaatactattatggttttattcaactggaagccgaggctggccatttattgtatttatttatttatttatctatctatttatttatttatttagagacagaatctcactcttgtttcccaggctcccaggctcaagagatcctcctaccttagcctcctgagtagctggtactacagtcgcatgccaccttgcccagctaattttttttttttttgagacgcagtctcattttgttgcccaggctagagtgcagtggcgcggtcttggctcactgcaacctccacctcctgggttgaagcgattctcctgtctcagcctccggagtagctgggattacaggcatgtgccaccgcgcctggcaatttttttttttttagtagaggcggggtttcaccatgttggccaggctggtctcaactcctgaccttgtgatccgcctgcctcagcctcccaaagcactgggattgcagacataagccaccgcgcctgttttttttgttttgttttgttttctgacagagtctctgtcacccaggctggagtgcagtggtgtgatctcagctcactgcaacctctgcctcctgggttcaagcgattctcctgccttagcctcccaagtagctgggattataggcgcacaccactatgcccagctaatttttgtatttttagtagaggtggggtttcaccatgttggccaggctggtctcaaactcccgacttcaggtgatccacccacctcggcctcccaaagtgctgggattataggtgtgagccatcaagcccagccctgcccagctaatttttacactatgggcaagtatgctgcccaagagtgctctggaactcctgggctcaagtgatcttccttcctcggcctctcaatgtgcttggattacaagcatgagccaccttgcccagccgaagctggccatttaaagttcctcatgctgctgaatcaataaggatggaaggcggctactattatgggctaagtgtttgcatcctccccaaattctttttttttttttttttttgagatggagttttgctcttgttgcccaggctagagtgcagtggcgcgatctctgctcactgcaacctccacctttcaggttcaagtgattctcctgcctcagcctaccgagttagctgggattacaggcatacgccaccacacccggctaattttgtatttttagtagagatggggtttctccatgttggtcaggctggtctcaaactcccgacctcaggtaatctgctgacttcagcctcccaaagtgctgggattaccagcatgagccaccgcgcccggcccccaaattgttttttgttttttttttttgagacggagtctcgctctgtcacccaggctggagtgcagtggcatgatcttggctcactgcgagctctgcttcctgggttcacgccattctcctgcctcagcctcccgaatagctgggactacaggcgcccgccaccacgcctggctaattttttgtatttttagtggacacggggtttcaccgtgttagccaggatggtctcgatctcctgacctcgtgatctgcctgcctcagcctcccaaagtgctgggattacaggggtgagccaccacacccggcctcggcccccaaattcttatgttgaagccctcacctccatgtgatggtattagaaggtggggcctttgggacgtaattaggctgacagtgccccatgatgggatgagtgtcttaaaagaaaagaccaggtggtctggctagtggctcacccctgaaatcgcagcactttgggaggccaaggtgggtggatcacttgagatcaggcgtttgagaccagcctgggcaatatggtgaaaagccatctctactaaaaatacaaaaattagctgggcgtggtggcgcaagtctgtaatcccagctacttgggaggctgaggtgggagaatcgcttgaacccaggaggtggaggttgcagtgagcccagatcatgtcattgcactccagcctccaacctggacagagagagcatctggagagtctctgtctcaaaacaaaaagaaaaaaaaaagaagagaccagagagcctttcttctctttgtccaccaagtgaagatatggcaagaaggcagccatctgcaagctaggaaaagagcccttgccagcacccaattgtgctatcaccctgatatgggacttcccagcctccagaactgtgagtaatcaatgtctattgtttaagccacccagtatgtaatactgagctgactaaaaccatcaccgaactagcctctttacatatgattagcaagaggaaaatggctctgttacttaatggaggaaggaggctatgtctgaaagccaaaaattcactggggacacatcttagcaggctcttgaccctaagacctggttaatggaaaagtagagcaacccaataaaaacaagaccaccaagaagtcaggtcttatggaataaagtattgagtgtccctatgaggcacagaacccttcgaaaggggattggaagaagtggtgaagaaggcggctatgattatcaacttagacttcatcgccatttgtagaaggaggcttctaacagctatgttttatgttaattggctcttttctcttcttttttctttcaaccttatattaagagcactggcagaagctagcggttttggcatcctgtaattattagctgtataaccttggccaagtaactcaacctttctgtgcctcagttactcatctgtaaaacagggtaataagtctcaacctcgtacttatgttgttataaagatttaacactaggctgggcatggtggctcacacctgtaatcccagcactttgggaggccgaggagggtggatcacctgaggtcaggagttcaagaccagactggccaacatggcaaaaccctgtctctactaaaaatacaaaaaattagctgggtgtggtggcacgtgattgtaatcccagttactcgggaggctgaggcaggagaattgcttgaactaaacctgggaggcggaggttgcagtgagccaagatcgtgccactgcactctagcccaggcaacagagttagactctgtctcaaaaaaaaaaaaaaaaaaaaagtaacactttgaacaaaaaagaaaaaaataataaaatttaaaaaagatttaacaattgggccaggcatagtggctcatgcctgtaataccagcactttgggagcctgaagagggaggattacttgaacccaggagttccagaccagcctggacaacaaagcaagactttgtttctacttaaaaaaaaaaaaaaaacaccaaagtcaggtgtggtggtacacacctgtgatcccagctacttgggaggctgagatgggaggatcccttgagccttggaggttgaggctgcaatgagccatgatcataccactgcactccagcctaggcgacagagtgaggcccatgtcaaaaaaaaaaaaaatgatccccaacatttagcagcttaaaacaaaaaacatttattatatcacactttctgtgggccaggaatctgggagggacttagctgggtggttctgctcagttctcttgggatgtttcagtcaagcagtggcctggggctgcactcttatctgaagactcaattgggagaaaatatgcattcaaggtcactcattggttgttggcaggctgtagttccttactgaatattggttgaagacttcattggcttactacctggacttctccatagactgcttgaatgtcctccccacatagctagagtgaatgactaaaaaagagagagaacacacacagcccaggtaagagttcagtctttctaagtcattatatgaaagagattcttttttttttgagatggagtctcgctctgtcgccaggctggagtgcagcggcacgatcccagctcactgcaacctctgcctcctgggttcaagtgattctcctgcctcagcctcccaagtagctgggattacaggcgtgtgccactatgcccagctactttctgtatttttaatagagatggggttttaccatgttggccaggatggtcttgatctcttgaccttgtgatccacctgccttggcctcccaaagtgctgggattacaggcgtgagccaccacgcctggccgaaaaagattcttgcacacacatgtttatagtagcactattcacaattgtaaaaatgtggaaccagtccaaatgcccatcaatcaatgagtggctaaagaaactgtggtatagatatacagtggaatactactcagtcataaaaaggaatgaattaatggcatttgcagcaacctggacaggattggagactattattctttttttttttttttttttttttttgagatagagtctcacttggtcacccaggctggagtgcagttgtgcaatcttggctcactgcaagctctgcctcctgggttcacaccattctcctgcctcagcctcccaagtagctgagactacaggcgcctgccaccacgcccggctaattttttttttgtatttttagtagagaccgggtttcaccatgttagcctggatggtctcgatctcctgacctcgtgatccgcccacctcagcctcccaaagtgctgggattacaggcatgagccaccgcacccggcctattttttttttttttttttttttttttttttttttactaaccaggggtttaacataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaataaagaagattcatgctaagctgtggcagaggggggaaggtatgatcgggtgggggtgggataaggaatggccatggaagataactgggtcaggttggaccctgggctgggagggggagggcaaggcccctcaccacaacttaagccaaacctaagctgcccccaggtgccataggtccctgtcccagcagggaggctgatgggcctgggcccatgcccctccccacctttgggggtcagatagtggccacccaggtttgctgggttggggcctgatacaggctctgcatgcccattcgggctgcctgtggagagagaatggagtcactgtttaaccatgctacctgcctcagccccagcagaccacaggaggttggccccagactcactgagtgcctgcagcagccctacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttgggaccctaacttgtcccttgccaaggccaactggctgccctctggctgtggggaccgcaaggagggacccacaagctgctggcgaagtcgctgcttcagttctggcttgagccactccacagccacctgctctccacagaggtgtggctgcccttcctccagggcctttttggccatggcagcggtccagtgcgagctgaatttgagcagagcgatctgcccgggcgcaggtccggggctgggcagcagccgcgcctcctgcaggccgggacccagcggctgcagcgcgggcagcagcgcgggcagcagcgcggtgcgggtcagattcggcggcaggcagtcaacgctcagctcacacttcccggtgctgcggcacacgagcagcgggcaggacggccgcagcgggtggttgtgcagcgggcgatggcggcctgcgcgccgcgccgcgagctgcagcgggcatatgcgaagccgcggttcaggccgctgaaggtcatcatcaggcggaactcgtagaggcggcccacgcgctggaacagcaggatagctggtgctcatacacttcctgaggcagccgcccgatgaacacctctgacccagccggcggcgggctgcccacccagcctgggggtggcccgccatacttcctctgcccgttcacctgcaccaggcgatgcctgtctccctgacccacgcctccagcgccgccttcaccctctcacaccacagctcacaatcccgcttggactgcatggctctctattctcttttttttttttttttttttgagacgtagtttcactcttgttctccaggctggagtgcaatggcgggatcttggctcaccgcaacctccgcctcccgggttcaagcgattctcctgcctcagcctcccaagtagctgggattacaggcatgcgccaccatgcctggctaattttgtatttttagtagagacggggtttctccctgttggtcaggctggtctcaaactcccgacctcaggtgatccacccacctcggcctcgcatagtgctgggattacaggcatgagccaccgtgccccgtctatggagactattattctcagcgaagtaactcaggaatggaaaaccaaacatcgtacgttctcactcataaatgggagctaagctaggaggatgcaaaggcataagaatgacacagtggactttggggaatcagggggaaaggatgggaagggggtgagggataaaagactattaattgggtgcagtctatattgcttgggtgatgggtgcacacaaatttcacaaatcaccactaaagaacttacttacgtaaccaaacaccagctgttccccaatatcctatggaaataaaaatttttttttagaaaaagagttcggtctttctgtaacctaatcttggaagtgtatattatcacttcttccataggctatcagtctcccagaccaaccctgctacagggtaggggagactacatggtatgtgaataccagaaagtgggggccactggggactggctatttggaggatggttactacaaactatatttgtaattttttttttcttgagatggagtcttgctctgttgcccaggctggagtgcaatggcacgatctcagctcgctgcaacatccacctcctgcgttcaagtgattctcctgcctcagcctcccgagtagctgggattacaggcacgcaccaccacacccagctaattttttgtatttttaatagagatggggtttctccatgttggtcaggctggtctcaaacgcctgacctcaggtgatctgcccgcctcggcctcccagagtgctgggattacaggcccgagccatggtgcctggctatatttgtaatattttaaccactaaaaaaaaaaaaaagaagaagaagaagaagaaaaagaaacaagtatgggaaaatattaagatctgataaaaccgggttatacttatgcaggtattcattacattattctccataactttttaaatgtttaataataaaagtaaaaatattttccccttaaaaatgtgcagagcatacctcaaataatgttgacaaagaatcctaaagacaattattattattattattttttgagacaggttcttgctctgttgcccaggctggagtgcagtgatgccacctgagctcactgtaaactccgtctcccgagtttaagcaattctcctgtctcagcctcctgagcagctgggactacaggcgagcaccatcatacctggttaatttttatattttcagtagagacggggtttcatcatattgcacaggctggtcttgaactcctggcctcaagtgatccacccaccttggcctcccaaagtgctagcattacaggcatgagccactgcaccgggcctctcaaactcctgacctcaggtgatccacctgccttggcctcccaaagtcctggcattataggcgtgagccactgcgcccggccgatcttccttcctttctcccttcccctcttcttcttcttcttcttcttcttttttaattaatagagatgggattttgccatgttgcttaggctggtttcaaactcctgggctcaagctatctgctcgcttcagcttcccaaagtcctgggattaagggcgtgagccactgcgcctggccccagtaaggatttaaaagctcaggaattattagtcagcttccttttttgttcatcctgttgtttgttcatttcagtctattccctttttataatttccttcttcataaggactatttctccttgtacttttgtgagaattcccgtaacttgtaatcccagctacttgggaggctgaggcaggagaatcacttgaaccgggaggcggaggttgcggtgagccgagatcaagccattgcactccagcctgggcaacaagagcaaaactcggtcttggaaaaaaaaaaaaaagaaaagaaaagaaaaaagaaaggaaggaagatcctcattggacagagcaaaaagcagaattgatggcactgaaaatgaaatcagcagctgatgtacaagttccagaatgtctcctagagtaacaaggaaatccgggtgtggtagtttatgcctgtcatccaagcactttgtgaggccaaggaggttagttagcttgagcccaggagttggagaccagcctggccaacatggtgaaaccccatctctacagaaaatataaaagttagctgggtttggtggtgggtacctgtagtcccagctactctggaggcgaaggagggaggatcacctgagtcccgcgaggtcaaggccacagtgagccttgatagagttttgccactgcactccagcctaagcaacagtgagaccctgtctcaataaacaaacaaacaaacaaataaataattgtagagacagaagataaaatggagcccggtgcagtggctcacgcctgtaatcccagaactttgggaggctgaggtgggcagattacttggcccaggagtttgagaccagtctgcccaacatggtgaaaccccgtctctactaaaaatacaaaaattagccaggcatggtggtgtgtgcctataatcccagctacttgagaggctgagacaggagaatcgattgaacccaggaggtggaggttgcagtgagctgagatcacaccactgcactccagcctgggtgacaaagccagactctgtctcaaaaaaaaaaaaaaaaaaaaaaggctgagcacggtggctcatgcctgtaatcccagcactttgagaggctgagccgggcagatcacctaaggtcgggagtttgagaccagcctgaccaacatggagaaaccccgtctctgccaaaaatacagtattagcaggtcgtggtggcacatgcctgtaatcccagctacctgggaggctgaggcaggagaatcgcttgaacctgggaggtggaggttgcagtgagccgagattgtgccactgcactccagactgggcaacaagagtgagactctgtctcaaaaaaaaaaaaaaaaaaaagagagagagacagggtttcaccaggttggccaggctggtcttggactcctgacctcaagtgatctgcccgcctcagcctcccaaagtgctgggattactggtgtgggccactgcatctggctcccaccatctctattaaaataagataaaataaacataaaataatgaaccgacaaaataataatacaattcattgtaagtaaaatgctatcctgagttctgtgagtcattctggataattcaaattctctagaattaccacctcagctgactttttttttttttttttgtagagaccaggctggtcttgaattcttgagctcaagtgatccgcttccctcagtctcccaaagtgctggaattacatgtgtgagccactgagcctggcctacaaattctttattatacaacacacagtagatgctcaataaatatttgctaagcagaaacatacactcaaaataccagaaattatcaaggaagttgccagttggtctcttgggttcttcctcccgacaggtatacacacctattgtaaagatgaacacattaggctgtgagaaaccaatactgttaaacattccaatcaggtgacaaactccctgggctctggtttatattaccaagcaacctgatgataacttggcttcctgtgtggcttgtttatagaaagagaatgctacccaggctgacgtgagttgcatttctgagttgatttctcactgtaaattaataaactggcattctggctacatagatcagtctctttgaactctttgtaccttccaccattagtgtgatttctaaggctgcaagccagacactgcccaagacccagcactggactctggtgagttcttccagctgttgccaccccaggaggctctgggagcccctgggaaccatccagcttgctctctgtctctacatttcagggtgtgggtttcagggcattcacaacattcctgcaacagaagagttttgggaacacccccagcaggatgtgggtgatttgaatgtatgtcagagatgtggttgtaactgagaaatcttaagcctagtgaattttattccacttgacttaaataaagagcacgtgaaagaaggggatctgaggacatctatgaacagggccccgagggcatgaacttactagtgtttatatgactagtgtttatctgggcctgtctagtctggagaacctgactctggtgtacccaagctttgcagtggctgtagaggtttgctcttttggagggagaagataattcattcctccaacacctgaatgagggtagattaacccacctccttcagctgcaatttggcaaatttctcttctttgatttaatgctcaacggacaaatttcctttcttcttcttcttcttcttcttcttcttcttcttcttcttcttcttcttcttcttcttcttcttcttcctcttcttctttttttctcctcttcttcttcttcttctcctccttctccttcttctccttcttcttttctcttccttctcctcctccttcctcctcctcctcttcctactcttcttcctcttcctctcctcctcctcttcctcctcctcttccttcttcttcttctttctttttttttcggttttgagacagggtctccgtcacccaggctggagtgcagtggcacgatctcggctcactgcaacctccacctcctaggctcaagcgatcctcccacctcagcttcccatgtggctgggaccaaggcgtgagctaccatgcccggctaatttttgtattttttgtagagacagggtctctccatgttgctcaggctggtcttgaactcctgagctcaagagatcctcctgtctcaggctcccaaagtcctgggattacaagcacgagccaccatgcccggcctcaacaggcaaccttctgattaataattagacctctgtgccggccgtcgtggctgatgcctgtaattccagcactttggaaggccaaggcgggtggatggcttgaggtcgggcgtttgagaccagcctggccaacacggtgaaaccccgtctctgctaaatatacaaaaattagcctggcatggtggcgtatgcctgtaatcccagctacttgggaggctgaggcacgagaatcgcttgaacccgggaggcagaggttacagtgagctgtcatatataatgaaacagttttactaaacttaggaagcagtgacttggtgtctctagaaattgcctaacatacacattccaggatacattctctgtcatctggaatctcctcccttccacaaacccacgctgtcttaagcactattttcctatttgttgttgacctaatctagaaaaaagcggccatcactctttctcccccactcagtccctcagtcccgaaacacccttattctccgcacttgtcaccccaccctctgctgcccccaccgcagcgcgcaaacgcacacgagtttaaagtttaggctgtgatgctatcctcgcccgcagatcacaggacagacattctcggggacaactttgcgaggccatgtgctcgtcccccttaggaaggaagagggagaaatccctgcggctcggttttgttccaatggtctgctcagcgagtgattcccgtttccccaaaggctgcccctcattagcatgaacggggacgcgggtgtggagaaggggttagaggagagaaagcaagcaaaagcccaggctcacttttagagcctgggaaccctgtctgcaaaaatgacagctagagctttctggctcctctgtttaatcgtcggatcatcccccgaagctccggtggagagaaaaagtaagatcggtgtagtgcggagccctgggagcggagcggggatctggggagggggcgcccaggcctcagccgccggccgacaaccgggccaccttccgtgaggccgcacacgctcccacaggcccgcgcctggcgcaagccgagaaccgcgcgtcgccgcgccgcgggcccgcgacggaggaagccccgagacgcgcgcgctcacgggccctacgcttccccgccgcccggccgcgcgcgcgcgccgccgagggccccgccggccctgcccaccccaaccggccgcgcgccgttgtgccggcccccggctcgccgcccgcgccgccgccgcgcctcagcttcagattcggcctcagtcagccgcgcagggacgcggagcccggcgccgagctctgcgcttgcgcttgccgggcgggcatggacgggcgagaggcgttctgcaagcgcgaaatcggtgagcccggccgccgcgccgccgccccgcgagcctttccgagtcccggagaatcctgcacgcgagatcccagggcgcccgacccatgcgggccgtttcgctgttgctaaaaaccaacgcccagggactgggagaggaactggggttcccaaactgttttttggaagcagcgatgaacgggatagtgcatgacgtggacgtgctgggcgcgggcatctggctggtgaccctgctggtggatcgggacgggctgtacaagatgaaccgcctgtacctcactcacccccgacgtcttcttcttccgagtccacatgttagtcctggactcctccagctgcaataaaccgtgtccagagtttaaacctggtattgaaactgagctgaatgacgctgcatatgtactttataccaccgtttgtaacgtgggtgccacagcccgggctgtgggtcgtccagtctttttttgggacggatgggggacagtattgtaacatgattaggatttagacgacaggtattatttccgccactgtgatttaagcaccgtcagccccacccccacgggtgagaacggcagctgttggcacaaagcgggctgtcaataaatagatgttgacaaatggagtgagcgaccaccaaacaccattgccagaagggactgtacagaactgagtttagaaaagctgcttttttgggggagtgtgtggagggttggtagcggggaatacccactcccacatcttttttttttttttttttttttttttagacagagtctcgctctgttgcccaggctggagtgcaatggcgccatctcagctcactgcaacctccgtcccccaggttcaagccattctcctgccctcagcctcccaagtagctgggattacaggctgagccactgcgcccagccccactcccacatctttctaggcatgtgctctgggaaatcctgatacaatgtgataaggacctttgttctgtaatgtgggctggttacgtattgctttcccttccccacaccccgtgctactttttgtatttttagtacagatggggtttcaccatgttggctaggctggtctcaaactcctgacctcaagtaatctgcccgcctcggcctcccaaagtgctaggattaaaggcgtgagccactgcactggcctggttgggttggttatcttctaaaggtcgctagactgtttccaccttgcctgtagactaaatatcagtttcaacttgtgcagcaagatagtagattgcagcttaggtatttcttaaaggccttatattttctgtttcatggcatttaaaagacgctatgaattaatgttctggttattttgtccaggcagcaggtatattgtgatgggccacatctaccataagagagggcagcttcctacagctctgctccaggtcctgagaggccatctctgtccaggggatggactgctgaggagcagcagcagctatgtgaaaaggtttaacccaaaaagggaagggcaaattcaaggtgcaattcatacccaatgcatttgaaacaaccatcctggcatttctggatcacaagagacatcggcaacaagacatgaaaggtctatcttcatgtaatgggtcctcctttagaagagagcccaaagctactctatgaatgacctgcatagttacaactgtaatctcgaaggtgtcactttgttatttacaagatgcttcttaaatgggctgctcctgagctcagtgtcaaggtgattcaactgttgtgccagacagtgatttacacagctcagataactgacctgtctagttaacagatcactgcttcatgtttttaaatattttaatttaatacattctttagtagaaatagtccacaaaacattttcctgaatttaaatacacaacttttatatcatgtatcaaacctgattttatattcaaacctgatttatattcaaaacttatatgtgaagattaaattcttcacataacagtaagcgcactagtcaaaagacatttacctatgaaacgtcatttagatcaaacacaagggtcaaagcccaggacaaggattaaaattttacacttaaaaagtaccaagccgggcgcggtggctcacacctgtaatcccagcactttgagaggccgaggcgggtggatcacctgaggtccggagttcgagaccaggctgaccaacatggaaaaaccctgtctctactaaaaatacaaaaattagccgggtgtggtggcacatgcctgtaatcccagctgagggaggctgaggcaggagaatcacttgaacccaggaggcagaggttgtggtgagccgagatcgcgccagcctgggcaacaagagcaaaactccgtctcaaaaacaaacaaagtgtacaaaagggccagtgtgcggatgggtggattaaaaaaataaattttaaaaaagtgccaaagggcttacttcaggcaaaagtgttcctgatgtaccaaagagtaagatatagtttattttcatgcctccctgctcctaataatgtatgttttgtgctgaactggcagctatcccaatgtgaactgtattctgagtgtatctgatatcatttttctattaagaccaagtataatgtttgcttgtaaagcaataaatcttgctttgaaattagaccttggatgcacctgtttatttttgttttgttttgttttagcctttgagccctaaaggtttgagaaaaagcctttctcaaattcattccccaaaccttggaaccaatattaaccaatgacagctcacaagcaagtgaattctaaacatttttcagttggttttaaaaaggtttaatcactagctaaattaaatattgattttatacctgagtccacaaagacatgagagtattttttcagaagataaggctgtacttcagtttataagaagtacggtgaacagagacaccactaatgcatagatgaagatgactgcctaaagagagacaggggaaggaatttcactggagagagagcagcctatttggcctcacggtgatgcactcaggaaggtcagaatgtgtcctgacgctgtccatggcacccagtagtagcactgtacacataaaggacatccaggacgggacgctagggaatcacaggagccaagaggcaacagcctaacattacaatacctgatactattatttgttccaattatggggcagacaggtaataaagagttgagaggttctgagtgttctatggtaaagcactactgagagatttctagagtattttccaaaaatgagttttgtccaaatttattataaattttactagaattgctttttgggagtcagatgcattattgcatgatagaattatagctaatgaagagcttctgagctagttttctttaagataaaaaaaattaactcaggcataactcaggccagtcaaatcaaagttgaatttttaaatgtcaaaaggctaggccgggagctgtgactcacacctgtaatcccagcactttgggagaccaaggcgggtggatcacaaggtcaggagtttgagaccagcctggccaacatagcgaaactctgtctctactaaaaatacaaaaattagctgggcatggtggtgcatgcctgtaatcccagctattggggggcaggaggatcgcttgaacctagtaggcagaggttgcagtgagccgagatcatgccactgccctccagcctgggcaacagagcgagactctgtctgaaacaacaacaaaaagtatatctatatggctaatttctttagttgaatttggttcaaattggatcaagtggtataatcttctaagaaaagtcttttagtatctcactccaagtatctagaaataccttagaatgtttcaaattattaaaaatacttctcggttggctcttccctccacctcctcaagtacttcattattttatccatggaatatccccattctcacattaagggcaagaaatctgagacctatggtaatagtttcttttttttttttttttttgagaaggagtttcgctcttgttgcctaggctggagtgtaatggcatgatgtcagctcaccgcaacctctccctcctgggttcaagtgattctcctgctctagcctcccaagtagctgggattacaggcatgcgccactttacctagctaatttttttttttttttttttttgtatttttagtagagatggggtttctccatgtttgtcaggctggtttcaaactcccaacctcaggtgatccacctgccttggcctcccaaagtgctgggattatacgtgtgagccaccacgcccagccgtatcatgatagtttcaatcaggaagagtgaaagctgtaataaccatgtaactttgtctaactaagtgtgcagagatctgaaagtccaccaggttggctctttaacataaagaagtagagagtttgcctaaaggaattagcagaaatagggaaataacttttatttgcagatcccaggaaggtagattacaaacaacagcaaatcttagtgtctctaaataacactctaggccatttggaatataaaaaggtaattattttacttcagaaaatatctccaaaagttcactttttttttgagacagagtcttgctgtgtcgctcaggctggagtgcagtggcacaatctcagctcactacaacctctgcctccccagttcaagccatcctcccacctcagcctcctgagtagctgggactacaggtgtgtgccacttgtccagctaaattgttgtatttttagtagaaacagggtttcaccatgttggtcaggcaggtctctaactcctgaccttgtgatctgcccgcttcagcctcccagagtgctgggattataggcgtgagccaccatgcccagccacaattttatttaaacctcctgtagaatttggataggagaataaaagctttaccaataggaaaatacttttcatgaaatggtttcaaggattgtgaacttggcaggtgaagcataacagttattgaaaatacttttagccaaggaaatctactgatgcaaattaaatatatttacaagcccaaggcctgtggtagaaacatcctaagagtatcacaaatgtacagtttactgcctggattattgaaagcaaaatagctgtgttatatagatcttaatagcagaagctttcaaagattactcacagaaaagcagctttcagaactcattatgttctaaaaaatgtatgtttttctttcttttttattttttttgagatgaagtctcactcttgtcccccaggctggagtgcaatggcgtgatcacggctcactgcaacctccgcctcccaggttcaagtgattctcctgcctcagcctccctagtagctgggatttcaggtgcctgccaccatgcctggctaatttttgtacttttagtagagatggggtttcaccatgttggccaggttggtctcaaattcctgacctcaggtgatcccccctgcctcggcctcccaaagtgctggggttacaggcgtgggccaccacacctggccaggaatgtgtgtttttcaaaaattacttttgaaagactaaagccctatagttgataaaactataaaatgtctttatgtatttgtatggtgatagaaactgtaaaacactttataccattaaatacacatgaaattaatatcttcctggtctcaggatttccataaaatttaccctttttaatttggcaatgctaacagctacagaagacatattaccaccaaccaaccgttgcttcattagaaactgcaccaaatccaatgtcaaaaacattactttatttttctagtatgaaatgtcctattacatacaaaagaattgctgtttagaatttgccacaatttgttgaaaacatagcaatctattgcctacaggtaggaaagttcttgctgcaacaaattttaaatgattaagcccatatatatttctatatatatgaataaatagtgcagaaatactgtgacgtgatgagatgcagaataattttataattcattaaaatgtagaattcttgcatcagcacagtgcatacaatatgtaactttttttaaaaagtaaaaggacaaaataatccatatttaagtatttccatcttaatattttaagcaaaaatgttttcatgttttcatattgagtgattagtctctttagtttgtaaacataggtttaagtgacatcttcatgtacaaaaaggaatgggcttcattagataaaattaagccagaataacctgtacacctgagcctgtaataagaaagaattgggaactgtagcaacatctttcttttaagaaaccaaggtctgggaaaggttttgcatagcagggaaacgttgaaaggaaggaaacttttaaaagcaataattagataaattccagaagttgataggacaaagctaatatgagttagaataaaatctagtagaatttttgcaaagctgcataatccagctatggcagattttatagaagctattaccacaatgcagtaatacaatgtgtaagaacattgaaaggaagaacatgcaaaatacatcttcctcattttcttcctactgcttacactacttttccttacatggaagaaacaaacaaaccaacaagcaaaaaacaaacccaatcaacaaataacacagaggatgagatcatctaacaaaaaatgtccttcatacaatataagtagctgtctgtaattggtaatttgcccagtatcacagaatgtacagatgaaggcaatgtgtatcttgtcgcattacctttttcgttagtatgatcaactgatgcgacaggattagcacccctgaagattcttctctgacgtgatgacaattgactgggaatgataaaacgaggggccactgctgtccaggagaattccaggtacaattagattcttttgcctttcatgaccttgcagccctccctccccacagaggcttacagataatcattagcacacattcaaagacacctctgtctgtgggagaaaaactatctccatttattttgtttcacatacatccatagttgaattttaatacaaaaagaaaaattagaatctgacaaatgtttacaaagaagataccttcaaatagattttactcatttcaacctggtgtggagtaattgacaaattgtactgttatattcaagtcaccagagtctgtagtccaggaccacttagcccaacctttatgcaagcttgattttaatctaccatgaacaataaactcattgttgattcgcagttgtgtgtgtgtgcacatgtgtacatagcagctcctttcatagaaagaaaagacatctagaggttgtcttgtacttttacgtacaggaatcattgataagatatggatggattatatgtaaccgtggctggattttataagaaaaaataattagttgacaaatgagggcagcaataaaaaagcatcttttttgcaacaataaataaatacagtcaaaagttttctttgagactctaaaccagcttcttcactgaagagcagacgtggcatttccatggagttatacttgaccccacagtatcattgtttcttgctttctttttcttttttttttttaataaacaaaattttctcgcttctgccacaataataaaaccatttgatcttgacaagataatggtgtcgttgacttttcttttttctttttcttttcttcctttttttgtttttgaaacggagttttgttcttgtcacccaggctggagtgcaatggctcaatctcggctcaatacaacctctgcctcccgggttccagcgattctcctgcctcagcctcccaagtagctgggattacaggcataggccaccatgcacagctaattttgtatttttggtagagacggggtttctccatattggtcaggctggtctcgaactcccgacctcagatgatccgcccgccttggcctcccaaagtgctgggattacaggcgtgagccaccgcacctggcaactttgcttttttcttgtccattggacaaaattggccaataatataattggactgttatgaccaataaaaacaaagtttaggtcaagtcttgtcaggatagcctcactaaaaagatctggctccttaatttaaaatagttcaggcaacaagattcttgctgtgttttatgttaggttaacatgctgaactttaggaagctgtagactgcagtttgttgttgtgagacctacagagtatagaaaaagggaacaattgagcacctttcatttttgaaaatgatgctttatgcggatgccaaagtaaataaatctggaagaagcagccatgttctttcattcacccttggcaagcgaatagaaaagaacgattaagaaatttttaacctataataataaaacttttcactgtacactaagcataatagctcactggaaaaagccaatatttaaaatatgtatgtatatatatttgtctaataaagattacaacattttcaggcaactggacaaatagagacatttacagaagcattaccattgtggtgaaaggtgcgtgtgtgtgtgtatgtgtgtgtttatttacacggatgaggggaatataaagggaaaaattatgctaaaacaaaagaaaaagcaattttaaaatcatatttttctattaaagtccagaaagtctcccagtttcacacagttttattcacaattttttttttttttgagacgaagtctcgcttttgtccccaggctgtagtgcaaaggcgcgatcttggctcactgcaacctctgcctcccagattcaagcgattctcctgcctcagcctcccgagtagctgggattacaggtgcctgccaccacacccggctaatttttgtactttttgtagagacgaggtttcaccatgttggccaggctggtcgcaaactcctgacctcaggtgatccgcccgcctcggcctcccaaagtgctgggattacaagtgtgagccaccaaggctggcctcacaacttttgtcagtaaaccaaattactgtacagttaccaggactaagtcaaaggactttatattgcaatagcagataaatttatattgcaatagcagataaatacagtattccaatagtttacaatttttaaatacattgtttcacgtggctgctagaataaattttttaccactatacatcgttaacattaaaaaattatattagctaacctgactttttggggggcaattttggattacgtaatcacaaggtacaataaaacagtgaccccaacatccagttctgattccagttaaaaatttagactaaagatatcacaatccgtaagaaaagaaagaatatggatggtataaatgatgaattataacaaagtgcagtaatgaaaacaatgtgcaaacaatgctggagatcataaattacaatgggaaaatatggcaaaggaaattctggaaacccataataaaatcaagtttcaataactggctagttatgtttcattctaccttaaatctggaaagcaatagaaattccctaaaaatgcaacagcaagttgtctttatacaattctttgcattgtaatttttttctttttttctttttttttttttttttgatttgtttgttttgagacagggtctcactctgtagcccagtctggagtgcagtggcacaatcatggctcactgcagcctcaacctccagggctcaggtgatcctcctacctcagcctcctgggtagctgggactacaggcacgtgccaccatgctcagctaattttttgtattttttgtagagatggggtttccccatgttgcccaggctggtctcaaactcctgggctcaagtgagctgcctgccttggcttctcaaagtgttgagatcacaggtgtgagccactgcacacagcctaatttgtttatttaagcagaattgagcaaacgtctccattcagctcccatgtgctttattgaaaattatgtcaacttcagtatattaaaaagctacataaaataaccaggtggcaagaagacatcctaagtggcccctacactatgcgggcc

SEQ ID NO: 31 - DNA, 440356 bp, Homo sapiens
ggaagaacatgcaaaatacatcttcctcattttcttcctactgcttacactacttttccttacatggaagaaacaaacaaaccaacaagcaaaaaacaaacccaatcaacaaataacacagaggatgagatcatctaacaaaaaatgtccttcatacaatataagtagctgtctgtaattggtaatttgcccagtatcacagaatgtacagatgaaggcaatgtgtatcttgtcgcattacctttttcgttagtatgatcaactgatgcgacaggattagcacccctgaagattcttctctgacgtgatgacaattgactgggaatgataaaacgaggggccactgctgtccaggagaattccaggtacaattagattcttttgcctttcatgaccttgcagccctccctccccacagaggcttacagataatcattagcacacattcaaagacacctctgtctgtgggagaaaaactatctccatttattttgtttcacatacatccatagttgaattttaatacaaaaagaaaaattagaatctgacaaatgtttacaaagaagataccttcaaatagattttactcatttcaacctggtgtggagtaattgacaaattgtactgttatattcaagtcaccagagtctgtagtccaggaccacttagcccaacctttatgcaagcttgattttaatctaccatgaacaataaactcattgttgattcgcagttgtgtgtgtgtgcacatgtgtacatagcagctcctttcatagaaagaaaagacatctagaggttgtcttgtacttttacgtacaggaatcattgataagatatggatggattatatgtaaccgtggctggattttataagaaaaaataattagttgacaaatgagggcagcaataaaaaagcatcttttttgcaacaataaataaatacagtcaaaagttttctttgagactctaaaccagcttcttcactgaagagcagacgtggcatttccatggagttatacttgaccccacagtatcattgtttcttgctttctttttcttttttttttttaataaacaaaattttctcgcttctgccacaataataaaaccatttgatcttgacaagataatggtgtcgttgacttttcttttttctttttcttttcttcctttttttgtttttgaaacggagttttgttcttgtcacccaggctggagtgcaatggctcaatctcggctcaatacaacctctgcctcccgggttccagcgattctcctgcctcagcctcccaagtagctgggattacaggcataggccaccatgcacagctaattttgtatttttggtagagacggggtttctccatattggtcaggctggtctcgaactcccgacctcagatgatccgcccgccttggcctcccaaagtgctgggattacaggcgtgagccaccgcacctggcaactttgcttttttcttgtccattggacaaaattggccaataatataattggactgttatgaccaataaaaacaaagtttaggtcaagtcttgtcaggatagcctcactaaaaagatctggctccttaatttaaaatagttcaggcaacaagattcttgctgtgttttatgttaggttaacatgctgaactttaggaagctgtagactgcagtttgttgttgtgagacctacagagtatagaaaaagggaacaattgagcacctttcatttttgaaaatgatgctttatgcggatgccaaagtaaataaatctggaagaagcagccatgttctttcattcacccttggcaagcgaatagaaaagaacgattaagaaatttttaacctataataataaaacttttcactgtacactaagcataatagctcactggaaaaagccaatatttaaaatatgtatgtatatatatttgtctaataaagattacaacattttcaggcaactggacaaatagagacatttacagaagcattaccattgtggtgaaaggtgcgtgtgtgtgtgtatgtgtgtgtttatttacacggatgaggggaatataaagggaaaaattatgctaaaacaaaagaaaaagcaattttaaaatcatatttttctattaaagtccagaaagtctcccagtttcacacagttttattcacaattttttttttttttgagacgaagtctcgcttttgtccccaggctgtagtgcaaaggcgcgatcttggctcactgcaacctctgcctcccagattcaagcgattctcctgcctcagcctcccgagtagctgggattacaggtgcctgccaccacacccggctaatttttgtactttttgtagagacgaggtttcaccatgttggccaggctggtcgcaaactcctgacctcaggtgatccgcccgcctcggcctcccaaagtgctgggattacaagtgtgagccaccaaggctggcctcacaacttttgtcagtaaaccaaattactgtacagttaccaggactaagtcaaaggactttatattgcaatagcagataaatttatattgcaatagcagataaatacagtattccaatagtttacaatttttaaatacattgtttcacgtggctgctagaataaattttttaccactatacatcgttaacattaaaaaattatattagctaacctgactttttggggggcaattttggattacgtaatcacaaggtacaataaaacagtgaccccaacatccagttctgattccagttaaaaatttagactaaagatatcacaatccgtaagaaaagaaagaatatggatggtataaatgatgaattataacaaagtgcagtaatgaaaacaatgtgcaaacaatgctggagatcataaattacaatgggaaaatatggcaaaggaaattctggaaacccataataaaatcaagtttcaataactggctagttatgtttcattctaccttaaatctggaaagcaatagaaattccctaaaaatgcaacagcaagttgtctttatacaattctttgcattgtaatttttttctttttttctttttttttttttttttgatttgtttgttttgagacagggtctcactctgtagcccagtctggagtgcagtggcacaatcatggctcactgcagcctcaacctccagggctcaggtgatcctcctacctcagcctcctgggtagctgggactacaggcacgtgccaccatgctcagctaattttttgtattttttgtagagatggggtttccccatgttgcccaggctggtctcaaactcctgggctcaagtgagctgcctgccttggcttctcaaagtgttgagatcacaggtgtgagccactgcacacagcctaatttgtttatttaagcagaattgagcaaacgtctccattcagctcccatgtgctttattgaaaattatgtcaacttcagtatattaaaaagctacataaaataaccaggtggcaagaagacatcctaagtggcccctacactatgcgggcccagcctaggtctcctttgctcctttaccaaattccctttgtcttgccacaggccccaggacctccaagcaacttcctctccttcatcagcagttgccagcagtcatcctctgggctctgccagcaagttggcagcagggtaggattcacaccccttggcttctacctcacagttaccaccaaaggcctttccaatttaaaaaagcaattttagaaattgaaccagaggaataaccaccatgtacaaatcaaaaagcatagaggggcttataatgagaagttgtgctcctctgtcctaccttaactccctctgaaatccaggctccctatgatcaatccccttgacctttcagttctctgggtagatttcttttcttttcttttctttctttctttctttttttttttttgagacagagtcttgctgttgcccaggttggagtgcagtggtgggatctcagctcactgcaacctcctcctcctgggttcaaatgattttcctgcctcagcctcccgagtagctgggattacaggtgcccacccttacgcctagctaatttttgtatttttagtagagacaaggttttaccatattggccaggctggtctggaactcctgacctaaccgcccacctcagcctcccaaaagtgctaggattacggacatgagccaccatgcctggtctgggtagattttttttcttttgagatggagtctcgttcttgtcgcccaggctgaagtgtagtggtgtggtctccactcactgcaacctccgcctcccacgttcaagtgattcttctgcctcagcctccagagtagctgggacttacaggcgtgcaccaccatgcctggctaatttttgtattattagtggagatggggtttcaccatgttggccagctggtctcgaactcctgacctcagatgatccacccgccttggccttcccaagtgctgggattacaggcataagccaccatgcccagcctgggtagctttcttatactgctctttcttgttttatcaactttcatttaagccctgtgatggcaaatgagagccaagctcacttaaccattttcccacctccatttttgagtcctagtcttttttgttttgttttgttctgttttgttttattttgttttttttttgttgttgttttaagatggagtcttgctctgtcacccaggctagagtgcagtggtgtgatctcagctcactgcaacctccacctcctgggttcaagcgattttccacctcagcctcctgagtagctgggattacaggcgctcaccactgcgaccggctaatttttgtatttttagtagagatgaggtttcaccatcttggccaggctggtctcaaactcctgacctcgtgatacacccgcctcggcctcccaaagtgctgagattacaggtgtgggccaccgcacctggctgagtccaagttttatttccctataatttaaaaattatatcattccatgctttgtctgtaggctgattctaaaagttgaaaaccaatgtcattatttttatttttattttttttgacacggaattttgctcttgtggcccaggctggagtgcaatggcatggttttggctcactgcaacctctgcctcctgggttcaagtgattctcctgcctcagcctcctgagtagctgggattacaggtgcctgccaccacgcctagctaatttttgtatttttagtacagatgggctttcaccatgttggtcaggctggtctcgaactcctgatctcaggtgatccacatgccttggcctcccaaagtgttgggattataggcataagccactgttcctggcccaatgtcattatttacattattacgacaatgtaaatatttttctctataccacctagtcctttgctaataaggcattcttttttttctttttttttttttttttgagacagagtctcgctctgtcgcctaggctggagtgcagtggcacaatcttggctcactgcaacctccacgtctcaggtttgagcaattcacttgcctcagcctcccaagtagcgaggattacaggtgcctaccacaatgcctggctaatttttgtatttttaatagagacgaggttttgccatgttgtccaggctggtcttgaactcccgacctcaggtgatccatccaccttggccctccaaagtgctgggattacaggcatgagccaccgcacctggccttttttttctttctttctttttttttttttttttttgagatagggtcttgttgtgtcgtccaggctggagtgtagttgcatgaacatggctcactgcagtatctgtctcctgggcttaatcctcccacctcagcctctggagtagctgggatcatgggtgcacatcaccatgcctggctaatttttgtattttgtaaagatggggtttcctcatgttgcccgggctggtctagaattcctgggctcaagcatcctcctgcctcagcctctcaatgtgttgggattacaggcatgaaccaccattcccagccaacaggccctcctacacaactttttgtttttagtggcgtttctaattgcctttcatttttatccctgacattctttggcttaatcatagccttatgtttttctgtcttaaacaaattatctaatgcatgagtcattgtcttgccctactgaccctctggggagtgctccattctcctgctaggatttggattgcttaccgcacagcctgctgtacaaatgtcaccttgagtcagagtaattctcattgctttccctgaacctcttgttttctgaacccaaataaataaaaatgtctggccaggcgcggtggctcacatctgtaatcccagcactttgggaggccagggcaggtggatcacttgccttgagaccagcttggccaacatggcaaaaccccatccctactaaaaacacaaaaattagccaggtgtggtggcaggcgcctgtaatcccagctacttgggaggctgaggcaggagaatcgcttgaacgcgggaagcggaggttgcagtgaggtgagattgcaccactgcactccagcctgggcaacagagtgagactctgtctcaaaaacacaaaacaacagaaaaatttctagcccagtgcagtggctcacggctgtaatcccagcactctgggaggccaaggttggcgggaggatcgcttgagctcagttcaagactagcttgggtcatatagcaagaccctgtccctaattaaaaatatatattattaaaaagaaaaaaatttgtttccttatttttgatagcacacttttttttttttttttttttcctgagcagagtctcactctgacacccaggctggagtgcagtggtgtgatcttggctcattgcagcctctgcctccctgtttcaagtgattctcatgcctcagcctcctgtgtggctgggactacaggcatgcgccactatgcccgcctaagtattgtatttttagtagggacgaggttttgccatgttggccaggatggtctcgaaatgctgacctcaaatgttccatccgtctttgccttccaaagtgctaggattacaggcataagccatttcgtgtctggccaatagcacacgcttttaaaaaatacctgccaagaaagggtaccctgagtccttacatgactgaaaatgtatttattctgactttacttgactgtttggctgcacatagacttctaggttgaaaatcattttttcttaaacttttagatttattcttccataatcttctagcactaaatgttgtagcggaaaaatctgacaccaatctaattcttgttttatagattgtctgttttatctaaaagtttcttttattcttaatgtttggaaattttatagtgatgtatgtaggagtgagtctttttccatttgtccacctggcttataatgtttatcaactgaccccttgctccccccacccctcatagagtgcaggggctttaatttattcactgctaaattccctgtatctggcacacatcaggttctcaatagtcatttgctgagtgaatgaatttattctgctagaatttaaagtcccgtgactcgcatcagctcagaaaatttttcttttattcttgtcttttttttttgagacagggtctcaatctgtgattcaggctggagagcggtggtgtaatcacagctcactgcagccttgaactcctgggcacaagtgatcacagctcactgcagccttgaactcctgggcacaagtgatcttcctgtcatagcctcctgagtagctaggactacaggtgcacgccactatgcctggttaatttttaaaatttttgtagagacatggtcttgttatgttggtaaggttgggaattttttcttcttcttttgtgagagtctcactgtcacccaggctggagtgcagtggtgtgatcttggcacactgcaacctctgcctcctgagttcaagcaattctcgtgcctcagccacctgagtagctgggattacaggtgtgcatcaccacacctggctaatttttgtatttttagtagagatggggttttgccatgttggccaggctggtctcaaactcctgacctcaggtgatccacccgcctcggcctcccaaagtgctgggattacaggcatgagccatcacgcctagcctagttttacagattttgtagtttcttgtttttggtctataacctgctgcctacttttcttgcttccttgcctatatatatattcatttattttttaattcctttgctgagaataaaaattggatactttagctgggcttgtccttcagtttttttgtttttgtttttgtttttttttgagacggagtctcgctctgtctcccaggctggagtgcagtggcgcaatctcggctcactgcaagctctgtctcccgggttcatgccattctcctgcctcagcctcccgagtagctgggactacaggcgtctgccaccacgcccgcctaattttttgttatttttagtagagacggggtttcaccgtgttagccaggatggtctcgatctcctgacttcgtgatccgccccactcggcctcccaaagtgctgggattacaggcgtgatccaccgcacctggcctcagttttttgtttgttttttttttttaaacaggcaagttcttgctgtgtcacccaggctggggtggagtggctcgatcatagttcactgcagcctcaaactcctgtactcaagtgattctcctgcctcagcctcccaagtagctgggactataggcactcatcaccaagcctggttaatttttttttttttttttggtagtagagacaaggtctcatactgtggcccaggctggtcttgaactcctggcttcaagctattctccccactcggcttcccaaagtactgggattacaggcataagtcaccttgcctggcctttcacttttattttaggtaaactgcttttaaaataccctcttagaaaccatcttccttgctacagaagagagaaagcaccccgtggcttttcctcaaaggaagatcactgtgggggctgggcgcggtggctcatgcctgttatcccagcattttgggaggccgaagcgagcggatcacctgaggtcaggagtttgagaccatcctggccaacacagtgaaacctcatctctactaaaactaccaaaattagtcgggtgtgatggcacgtgcctgtagtcccaactacgcgggaggctgaggcaggagaatcgcttgaacctgggaggcagaggttgtattgaggtgagatcacaccactgcactccagcctggcaacagggtgagactccatctcaaaaaaataaaataaaataaccgagtatgcacaattcaactgtaatagatactatcaatttaccctccaaagtgaccataccaatttatacccccaccagccttgctaaaagtattctaagatattaattttatggttaataaaatatacactgagacttctgaaaaaacttcaaattcaactcatgtgtacccacaggttccttaataacaccataataatctggtgcatcattagggtctactggttcaaggaaaggctgggccatcttatgggcctataatgaaaaagtaggcattcttattgtcagtgaaaacactaattccatttaagattcccagttgagtcactacatcaatgaacccaaaagtcagttttaaatgcgatacatgaaatactttatattaggtgatttctgctctagtaataagttacctaagatgagcttcctctgcaataatggtactcaaagcttggtcggaagaccttggtgtggtgaaggggtgggttgcccctccacacctgtgggtgtttctcgttaagtggaacgagagacttggaaaagaaaaagacacagagacaaagtacagacaaagaaataagggggcccagggtacctgcgttcagcatatggaggatgctgccggcctctgagttcccttcatatttattgatcattcttgggtgtttctcggagagggggatgtgtcagggtcataggataatagtggagagaaggtcagcagataaacacatgaacaaaggtctctgcatcatagacaaggtaaagaattaagtgctgtgctttagatacacatacacataaacatctcaatgccttacaaagcagtatggctgcccgcgtgtcccacctccagccctaaggcggtttttccctatctcagtagatggaacatacaatcgggttttataccgagacattccattgcccagggacgggcaggagacagatgccttcctcttgtctcaactgcaaagaggcattccttcctcttatactaatcctcctcagcacagaccctttaagggtgtcaggctgggggacggtcaggtctttcccttcccacgaggccatatttcagactatcacatggggagaaaccttggacaatacctggctttcctaggcagaggtccctgcggccttccgcagtgtttgtgtccctgggcacttgacattagggagtggtgatgactcttaaggagcatgctgccttcaagcatctgtttaacaaagcacatcttgcacagcccttaattcatttaaccctgagttgacacagcacatgtctcagagagcacggggttgggggtaaggttataaattaacagcatctcaaggcagaagaacttttcttagtacagaacaaaatggagtctcctatgtctacttctttctacacagacacagcaacaatctgatctctctttcttttccccacagtgtggggggtggaacacaagcttagaagtcacaaaatcagtattctgggccctacatgatgagctgtcactgagtgatgctggcattgcaactgcttctgtaacaggtgggatgggttcaaagtgtggaatcattaccacagctgattaatgatgaggtggcagagatgtgatgttagataacattcaaccacacattgagactacgattccctttttagtttcttcaattcttgtgattatgataaaaatagaagaaagtttcaatccaatgcactatatccttttatttccccccattgttttgagacagggtctcgctctgtcatccaggctggagtggagtggcacgatcatagctcactgtagcctcctgtgctcaagtgatcctctcacctcagcctcccaagtagctggataaacaagtgtgtgccaacatgcccagctaattttttatttttattttttgtagagatggggtctcactttgttgcccagattggtctctaactaattgactcaagtgatcctcctgccttggcctcccaaagtgctgggattataggtgtgagcaaccacactggccttctgtgtcttcaatacacctgtatcacttgctaatcctgcaaaccatacctatcctggttttcttttctttcctttttttttttttttttgagacagagtctcacactgtcacccgagctggagtgccatggctcgatcttggctcactgcaacctctgcttcctgtgttcaagcgattctcctgcctcagcctccctagtagctgggattacaggctcacgccaccacacccgactagttttttgtatttttagtagagacggggtttcaccatgttggccagtctggtctcaaactcctgacctcatgatttgcccacctcagcccccacaaagtgctgggattacaggtgtgagcccccgtacccagccacctttctgtctttcataaggaaaataataactataatctaatcatactgtttctcaatccatgggagtgagaggaagtttctttaaaaataaaatgtataaagaagtgagtcacgttagattatctgagtgttagataagctgaggtggtgtggggatatggtaaagctcatgacactggtatgtgaaggactgaagtttgtcaagcccttcactagactagctgagagtcagtaaataatcactctaagattggaaacttgaaatcctaacattggaaacttgaaatcctagaaatgcttccaaaattatgccagctgatttcattttcaaatgctgcacacagaggggctctcatctgtaaggaacggagcaccctcttcaactcctcatcatccttctctgttagtggtgtgagcactgtcatgacatcctctgttgactggcactgtggacagacatactcatcaatgagctctgcctcactctgcaagatgccaatgcagcacccatggtaccaattctgacaccgatcatggccaataaaaaatctgcaagatccgaaatggaaatgtgagttcaaaacagatgggatgatgttacttataataaagcatgcacctgaaaatttgctaaaccctgggatataaaatagttttagtattgtggttttaatactttcaagatcgacattccagtacattaatttagtatttttgatgttaagaacaagcagtaaaaaaatttataagaacactgtaattttggagaaccaatttaaagataaatatgaaacattcaattgattttaaagctgaaaacaagtcacaaatctttcaactagtactgtaccatgtgggagttcaaaatcctataaggtaataacagagtctcaaagcttatacccaaattagtgtttttctaacctataataaagcaccatttcaaacactgataaagtccaaacaagtcaagctagtttaatctcattaatttctatgttacatattgaagaatcaaatctaccattaaaccacattttccccaatgtgtctcaaacattcactatgaagcaagataaattttgaagggtaggtaaaaagggaaaaagagaaaaaaaaatgaaaaggaatttgtaatgtaagtgtataacaaatgtagaaaaaatctgctttttattttaaagtaaataagtaaccagtcagagcaatttggcttcctaaattattaaatgtgatgctcttattagaactcactgtgactgcaggtgttctgcagatacagtacaattcctcactgctgccctcttgtgcccatttacaatcattacagatgtacacatccattttcttagcctccttttctgcgatgccaacacattctccataatagcagttagtacaaagatcacagccaatatagaacctagaagtattcacaacgaaaatgacaatgtaattgtcgttttgagctgcatggtacttaaatctgtcttccctgccttgcttcatttttttacaggataacttcctgctatgagtcagctaaacattcctgaatccaaccattctacccctggcaaactccagtatctgatgctctatcacatgtgcaaacaaagtcactcacatgggtttcaacaagtacactgcttagtgaaatatgggtctttaaaaacatactggaatttgaaaaaataaaccacacactgatggtaatgtcttcctctgaatgaatgtgtgcaaaactgtaacaggcacaaaaaccaaagccaaagaatcaaagacttacacctgtcaaacctattccacagaagccatttcaatatcagggctatttcttagataggtttaaaaatgtatctcacaatttaaatttgaaaacaaagcaaagcgcaaacaccaagtagaagttacactacaaggaccatgcaggtcagccaggtgtagaagataaacggtcaaaatatgctaagaagaagaaaactaagaaaggtacatagagcaattcaatctctaccaggttttctgaataaacattggaatttaatcgaattaaaaataatttctcataatggaatatggcatgggccactttttcagttaatataatgtttgtgacaatgtgggcagtggcctggctagttaacgggtagggaacgtggaaggagctgcttcagttcaacatcggggacatggtatggggaaggatgcaaagatagttatccagaatctgtctacactgcttggcagggtctacactgcttggcaaggcggagctgtgtaagtgtgtgattgtggagtgcacagtggcctctgtaataaaagacgtaatgacaaaagaaaaagtaaatgtaacaaacgcttatacagtgtgtctacaagtgttgataggcacagtgtaggaacatcatgtcaaagtcatagtgagaattaccatgaatcacagggaagcaggctggctttgccgataccattggcactcctagctctaccaaggcatttcttggtagattcacctagaggaatggaagtcgtcctcaagcttcaaattgacctgcttcatgaatgtgaaggaataatacatggctatgtagtttatcctgttaccactaacttttttcttttgtctcgctgtataacccaggctgcagggcaggggcaggatcacggccccctgcagcctggacctcccaggctcacatgatcctcccacctcagcctcccgagtagctgggactacagatgtgcaccaccaggcccggctttttttttttttttttttttttgacggagccttgctctgtctcccaggctggagtacagtggcatgatctcggctcactgcaacctctgtctcctggcttcaagcaattctcttgcctcagcttcccaagtagctgggattacaggtgtgtgccaccacatctggctaatttttgcatttttggttgtgccacgttggccaggctggtctcaaactcctgacttcaggcgatccacctgccttggcctcccaaagtcctgagattacaggtgtgagccacagggcccagcctcttttcatattttttaaaaaaagttttaatgagcagtgaggacgaccagaggtcactttcgtcaccatcttggttttggtcggcttctttactgcatcttgttttttctttttttttttttttgagactgggtctcactctgtcacccaggttagagtgcagtggcacaatctcggctcagtgtaccctgcacctcccaggctcaagtgatcctcccacctcagcctcccaagtacctaggaccacaggcacgtgccaccaagctcagctaattttttgtatttttgttagagacagggtttcaccatgttggccaggctagccttgaactcctgacctcaggtgacccatctcagcctcccaaagtgctgggattacaagcgtgagtctctgtgtctggccaacatactattgtctcaatatgcattttgccatactttttaagtgcatctcttctgctatcctgtagtacaacttactcttggaaatgatcaaagcaaactatattaccctagggacaaacccattgtgattggcatccacgaacaaatttggtgtaaagaaatcatatctatgaccaagagggtttctttcttatttggagataagagtctcactttgtcaccctgcctggactgcagtgacataaacacggcttgctatagccttgacctgccaggctcaagtgatcctcctgcctcaaccccttcaaatagctacaggtgctcaccaccatgcccagctacttttttttttgtagagatggagtcttgctgtgttgcccaggtaacttacctcctgagctcaagtgatctgcctgcctttgcctcccaaagtgctgggatgacagttatgagccacttgtacccagccataagaatatttcttaaaatctgacttaaaatttttttaaaaaattcttttagagatagggtttcaccatgttggctaggctggtctcgaactcctgacctcaggtggtctgcccaccttggcctcccaaagtgcttggattacaagtgtgagccactgtgcccagccaaaatctgacacatttataaatttctacaataattttaaataccaaaaatattcccaaaacgtttcatcatgattatttttcttcctaaatcttatagtctctcagaaaaataacttagcccacgtttcctttaaagagtttttaatttttttaatgaagggccgaattaattttatttttccttctttgaaaaaattcatccagcacactggctcacacctgtaatcccagcagtttgggaggccgagggcggaagatcacttgcgtccaggagctcaagagcagcctggccacatggtgaaaccccatctctactaaaaatacaaaaatgagccaggtgtggtggcgcatgcctgtagtgccaactacttggaaggctgaggttggaggctcctttaagcctgagaggtgaagacttcagtgagctgtgatggcaccactgtgctgcaatgtagatgacaaagtgagaccctgtcttaaaacaaaacaaaacaaaacttttttttggagacagggcctcacttgatcgccccggctagagtacagtggtgctatcatggctcactgcagggtcgacctcctggggtcaagcagtcccctggcctcagcctcgccaagtagctgagactacaggtgtgcatcacaacacccagcaaattcctttttgtagaaacagggttttgccatgttgcccaggctggtctcaaaatcctggcctcaagtgatccacccacctcagccttttagaatgctgggattacaggctgtgagccacaactctcttggcctataaatgataatttaagtgaatctctgaagctacagttttttgtttcgagatggagtctcgctctgtcgtgcagtggcatgatctcggctcactgcaacctccgccttctgggttcaagtgattctcctccctcagcctcccaggcagctgggattacaggtgcctgccaccatgcctggctaatttttgcatttttagtacagacggggtttcgccctgttagccaggctggtctcgaactcctgacctcaagtgatcgtttcacctcagcctcccaaagtgctgggattataggcatgagccattgcgcccagcctctgaagctatagttttatagattctaaagcagagacttcatatagatgtctatgaaaagccaaaaacaaacaaaaaacccacaggaaaacctgattccccacgccaaaatttcaaggatttgcctaaaggtaaggtccatctgtacctgaaataagtttgctgtgcctctttttctgcagggtaacccagccctatgcaccaatcattacatgactacctcaggaagcttttaaatatatcacaaatattttaccaaataaacctgaatggccctggtttaatgaatctgcttctctgtctatagactatctagtctcataaagtcaaaagagaagcaatgtgacaaattattcaacagcccttctctatttatagagagagactgaacttcttctttggttagaaagaaaaccttgagtttcatttcctagttcatatatttttataacatcgtgggacggattttgggagaaccaagatggtatagcgggtgcacactttgatcctccctctcccttcaagaacatacaagtgagagtaaaatataaaaaagagaaattgaaaagacatagtcatgcttaaataagttacaacaatctcaatggaacagacacaaaactgtgagcaggactaaaactgcaggccttctagactccagatgcagaaggaggaagtggtggctgaacactaacagtaagagtttctcgggggtaagggaggctaacatgctgtgtgtgaggcagtgataggctccctgctggaagttaagggttgactgggctacactgggcttcaggagagaagaaaacaacactcctctcactcaaaataagcttgcaaaattcaaatgtttgaaaatgaaaatgtgtaatatgaaaaaaagacaaccagggcccatacggtggctcatgcctataatcccagcactttgggaagtcgaggaaggaggatcacttgcttgagcccgggagtttgagaccagcctgggcaacatggcaaaaccttgtctctacaaaaaaacaatgacaacaacaataacaacaaaaaacaccccaaaattagccagagatggtggcatggcacgcgcctgtagtcccagatacttgggaacctgaggcggaaggacttactgatctgggtagggggaggctgcgatggggtgtgattgcaccgctgcactccagcctaggaaaaagaataaggccctgcttctcaaaaagcaaaaaaaaaaaaaaaaaagccaataaaatcaatggtctaatctgaattcactccaaatgaaattatagagcaatttgacaggccaggcccagtggctcacacctgcaatcccagcactttgagaggctgaggagggaggatcacttgaggtcaggagttcaagaccagcttggctaacatggtgaaaccccgtctctactaaaaatacaaaaattggctgggtgtggtggtgggcacctgtaatcccagctacttgggaaactgaggcatgaaaaccacttgaacccaggaggcggaggttgcagtgagccgagatcatgccactgcattccagcctgggtgacagagcaagacactctctcgaggaaaaaaaaaaaaaagaaaaggaaaacaactcaagggttggataacattgccagtataaccataattcaaaacaagcagcagaatttggaggataatttgtttcattctcaggaaaatgtgaaactctgaaactgctttttgagtgcagggtatttccggggcttttcctaaagtcttaacccttggctctgaccccttatttgaagtttggagagcagaaccgaggattgtattactacagttgtggacacaggagaggggttagtctccccccgctccaggagtaagggatgctgggctgctcgaacacaggccttgttagaactcccttcaaacaggatcccagagatgtggggagaaggtaactggccttaagaatgattgcgctacagctttcgaaaactataatgcctttcaaatatggcttattgcttggatctcaatatctcccacgtatcttgggtggaatattttgccgaagatctttctgtcaatcatttacaatcatgtgctgcaaaatgaagtttgggtcaacagtagaccacatatatgatggtggttctgtaagcgtataatggagctatccctatataggtataccatttttatcttttttttttttttttttttttttttgagatggagtctcgctctgttgtccaggctggagtgcagtggtatgatcccagctcattgcaacctccacctcccaggttcaagtgattctcctacctcagcctcctgagtagctgggattatagacacgcgtcaccacactcagctaatttttgtatttttagtagagatggggtttcatcatgttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaatcacctagtgacacatttctcaagctcctcacgtggcaagcaatgcatgactgcatatgaaagctcttaaatagagattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataacgatagctccatccctaaatgaggtgaatcttggactctcttccattttattttattttatttttttgagatggagtttctctcttgttgcccaggctgaagtgcaatgttgcgatctcggctcactgcaacctctgcctcccaggttcaagtgattctcctgctttggcctcctgagtagctgggattgcaggtatgcaccaccacacctggctaattttgtatttttagtagagacggagtttcaccatgttggtcaggctggtctcgaacttctgacctcagtgatccccccacctcggcctcccaaagttctgggattatgggtgtgagccaccacacccggccccccttcaattttaaagccatcactatgcaccctatgtctatgccaagcactaaaataagatgaagcaccttcttggagtttacatgctggtaattatgccagacagtaataaaataggtaagaacggctgtgggggaagtcagctgggttctagttacagtcgcatttcaggaaatgatttaacatgctgactttaacaacctaagcctcttctccatgtgtgcacacagggtagatctctgaacacaggtgaccctagaagtgctgtaacttctaggggaatggctgtgttgagtcaaggcaggatgacagttcagcctcctcccaggctagtgcaaagggctcttcactcggattaaaaccttctctcccagaccgaattgccaactcccaacacccctcctacagaaaatttggagtcctcgcttattccctggcagcccctacctaatagggtggtgaattaattatcaaacatgcgacagtttagcgaaaatggcaacactttggaataagtgactgtaatgtgcatcctggcgcccattttgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccaccccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtgacataaataaaggtgtcataaagacagggcggggctcacgcttagaaggggcacgagcgtctcggagctgccagaatgtcttctgctcagtgcccggcactagtgtgtgtcatgtcccggctgcgtttctggggcccatggcccctccttatgtggcaactattgtggctactagtcaaggaggctcagcctctggagtgggtcaaggacccgctccagctcacctctaatcccctggggccgcctgagtcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaaggctccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcaatgatgatgctctaagtcgttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttaccatatgtaggagagttggctgttcacatgattattcagtcctttagttttgtccagaactcatttttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggcgggcggatcatgaggtcaggagatcaagaccatcctggctaacatggtgaaaccccatctctactaaaaatacagaaaaaaattagtcaggcatggtggtgggtgcctggagtcccagctactcgggaggctgaggcaggagaatggcgtgaacctgggaggcagagcttgcagtgagccgagattgcaccactgcactccagcctgggcgacagagcaagactccatctcaaaaaaaaaaaaaaaaaaaaaatgataggagggaagaaagagaataggcataaaaagggaggtatatataattaagtactaaaagataatgcagaccattggtgctagaatttgccagaatctgtgatccttgaggtgtggagatgctacatgggtaagctaaaactttacttgggtcttaaagagtagctataatttgttaaatagaagaaaaatgggagtacagtctaggcaaacgcatggctacaggtatggttggaatttagtagaccaatgtggctacaaagaattaggtgagggagcaatgaagatacgattctgtaaaaccttgattatcagctataggagtttgaaagttacacagtgaggtatggaaagccattgaaagtttccaagcaagagagattacatgatcaaaacaggaagattattttattttgttttttgcattatgtgcaagtgtagacatgcagaggattgttttagaatccatatgtaaagtgtccaaaaggaaaagcttaattcagggagacaaaatagaaaggtctagcaaaatctaggagtgaagtgtgaaggggccaaatcagatcagttgtaataggagtggaaagaaaaagcctaggatgtttcaacagagggcactgggccaaagctttggtgttacctggcatagggtttctttcttctcatttgttgataatgataagcttttgcccatatttctgtggaattatttaccattttggtactgatttgtagaagtctgtttagacacataagtgcttttagataaaatacttacattcaaagtaattaactggcatcatctgtccaagagatgggatggataagaagttaagcttccaggagatgcctcatcatttgtgccagtgaccccgcataatttcttgatgaattgtgcaaactgggaagctgatagctctggaaatgagaaagcaggtgttattttctgtttctgaatatccccaacaaggttgcaatgattcttttacttatcgtgttcattgttttcctacctattcaaggatataaactgtgtttcttcacagaaatttccaaggaaactatatttcttacattgatggaaatgtatggaaagcatacagttggactgagaaactgtgagtatattctctccaaatatgacaaaaagctaactgcattgtaagatccttcttggtccagaattttgaggtcggtacctctgaggaaagatatttctcctccatgccccaaatcaaccactgttgattgcaattgtatggtcattttaaaattaaatttggtaggctctctttaaaataagaggcaatttaaatttattttttatcatacaaatagtacatggttatattcctttttgttctcttttttgttttttttttcagagacagggtcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtattttttgtagagacagggtcttcctatgctgcttaggctggtcttgaactcctgggctcaagtgatcctcccaccttggcctcttaaagtgttcatattacaggcatgagccaccacccgcagcccatgattccatttttaatatataaaaatgcaataacagatataacaaaaactctccttgtgccctactccctcatccctgaagtaatgctactctgcatttagtatacatgcttccagacttttcctcatttacctacatacatatttacataaagcaaaatagatttgttttgtggttttaaaattttttcttcgcataaagggtaacatcttgcaacttgattctttcacttcatgatatgccttagatttctttccttcccagtacttagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctggaaatggaattcttggggtgaagactatgtagatataaaattttaattgccttcaaaaattttgtgccaacttactctattgtcagcagaatatgacagcattcatttcccaacaccttttcaccgctgggtattctccaacattttgctgaagttatggatgaataaaagggattccatctaaatgtgaatttttctgattactcatgaatttaatttagtatctttatatgtttattgaacatttgtgtttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattatttcaatgtatatagacaagccacgatgagttctaaattaaaaataaacatatgctaggcgcggtggctcacgcctttaatcccagcaccttgggaggtaggcggatcacctgaggtcaggagtttgagaccagcctggccgatagggcgaaaccccatctctactaaaaatacaaaaagtagccaggcgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagcgattctcctgcctcagcctcctgggtagctggaattacaggtgccctccatcacacccagctaatttttatatttttagtagagacagggtttcaccatgttggccaggctggtctcaaactcatgaccgtgggtgattcacccaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggcatgctagcaatgatcttttgtaaggatgtttacatgggtatctgcttcataattattaaactgaatattttggccaggtgaggtggctcatgtctgcagtcacagcactttgggaagcagacacaggaggatcacttgagccaggagtttgagaccagtctgggaacagagtgagaccctgtctcaaaaattaaattaaattaaatataaacaacatttatgttatgtgcactttatgcacattatagttctccaatttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataatagaatttggtgggaagaaacccactcttcaaggggtgtgcttgagtgtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtaaaatgaataaggggttcaaattagataatctctcagatttctttgagcaataaaattctgcaattctgtaagtttgtatagggtctcagcccatctctaacactagctacctcctgtgcattttcagtttttaagttatatagacaaaatacagacaaaaacatttcacatggtaagaaaatctgagcagtgactgacacccatatgaaccttgttttataagggttcacatatcattctttttctattcagtctacaaccaatagatctaatctaatttatggtctatttttaaatagcccattaagttaagaatgggttttgcatttttaaagggactgtgaaagaaaaagaaaagaaacaaagaaatatgcgagagatcatatgtggcccataaaacctaaaatatttactgtctgaccttcaccaaaaaaaatttcaaaaagttggtttagtaggatgaaaggaactaaagttaacttcagatggttgcctaaaggagaagaaaatggagaccacctgcattcatttgaacatcattaatccagaattttttggtaatttaatcggaattaaattaacatttaaatattaaaaatagctgaattatatcaataatattatcaagaatattaagctaccaagagaatagactggtattaaggatttcatttcaggaattgttatattaaaacagatgtttaaaatgatggttaactgatagagctagaaatgtttacactaagaagcacatcagaaatgcccctaactcttcactaattacaaaataacgatcgccccagccctgttaccagaaagggatccctgtatttctgtctgtttagagacaagaagatactatgttcattgctatgaaagcttgattcttaccctttgtccatagaggtctgtatgtcattaatccttattaagctcattagtgatgctcttttgcaaacagattctttcaaatatagaaggcttaaggaaagtgggtgtaaagaccctcaggtggatgccaaagtgctacagagaccatgaaataataaaactacatttcctttaaaatagttattttccttctactcactcccccagctattcatttattttacaaatatttgagtttgctttatttccatgtgtcagttttaaacatggtgggcaatgcagatgagcaagacctagtccatgctttcagggagtttatgctcagaagaaatgggataaaaaataactacattaagaagaagaaatggatgtgggcactaggagggataaattgtttctcgaacatagaagaggaaaaaatgccttcaatttggacccaggaggatgttactagaacaatgccatttgaataggactttgaagggccattgtgtaacatcagacagacatcttggggaaaatactctaaacttgcaaaaggaaaatgggagggcaaaacacaggaaagtattcaaggaatgccatgagtacccgtagagtacaagaagggagagtaggaaaatggagccagatcttctagagctttgaatgccaagctgaggagccaacatggggaaccgtgttaccacagcagcgctgtaaggtagatctgcatcacagtcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactggagatggagatatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagtgcagtggtgcgatctcggctcactgcaaggtccgcctcctgggttcatgccattctcctgcctcagcctcctgagcagctaggactacaggcacgtgccactaggcccggctaattttttattttttttgtagagacagggtttcaccgtgttagccaggatggtctcgatatcctgacctcaggatctgccagcctcggcctccgaaagtgctggattacaggcctgagccaccgcacccggcccgactattttttttaatattagaaattgtgtatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggcagggttaggggctctggaatgttcaaatacaagtccaaacgtttagagttgagatgaaaaataggtattcagtattattctaaactcttgctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctctttgctattcttgaaatatgattaaaattttaccagtagaaagctactaaaattatacagcaaatcctttttgtctctagcaaggattattgtgagaattattacacagatcttagtgaatcatcagagagcagtggttctcaggtggtgtgattttgcactcaggtggcatttggtaatgtccggagacagttttggttgacaaaactgtgagtgtgctcctggcatctggtgggcaaaggccagatatgctgctaaacatccttcaaggtataagacaaacccccatggcaaagagttatatagtccaaaatgttgatggcactgaagttgtgaaatcctgttctagagaaataaagatcacttaacacaggtatttactgaacattcactgttttgtatctaatgcaccacgtgtgcagtgttaaagtataaatcataagccagtatcttccacagtcagatttccttagtgcatagagaaaggattgaggttatgttccatcctatataaattagaatcatggcaaatgataaatgttctgaaataattttttttttctttggcttgtgtcttttttttttagaaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcatgtcttaagatccattcatttttctcaaatggggaagctaaggtacaaagaggccaagagacttatgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaattagctgggcgtggtggtgcagttttttgctccctggaggactttgtgttaagcttccttccttgcagctaaatgttgcagacatctaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcaaaacctcatctctactaaaaatacaaaaattagcaggtcatggtggcgggcacctgtgatcctagctatcgggaggctgaggcacgagaatggcttgaacccgggaggtggaagttgcagtgagccgagattgtgccactaccctccaacctcccctccaggctggtctcgaactcctgtgacctcaggtgatccgcccacctcagcctcccaaagtgctggggttacaggtgtgagccaccatgcctggccaagatggtgtttatgttaagctattgtgcaaaaaaaaacttttgtaaagaaaatatatcactgtatcttaattccatatactttcctgactactcttctaccataattgcaaaaattctatgatttctctgtataacatacccatcaaatcagagtgggtatattcagtggcctgaaggggactcaaggtgaagattctcctctacatctgactttagaaaagactttccacctgccttgtggttcagaaatctagtttcacacagttcatttcaagttagagggaggcattcaggatgtgtctggactagagcagcagtttctgcacatgctcccctctgtcctcattaatttgctgatgcataacttaggaaaagtacactaaaggtctgtttttcttttgccctcacaccagagaacaggctcattaggtccctccaccaagaggtttaggtagcatcaatacaaatgttttaaactcaccatctttactaagcactttataccactgggagtccctcataaaaatctggtggccgggagcggtggctcatgcctgtaattccagcactttgctgaggtgggtggatcacctgaggtcaggagttcaagaccagcctgaccaacatggtgaaacctgtctctactaaaaatacaaaaattaggtgggcatggtgacaggcaactgtaatcctaggtactcaggaggctgaggcaggagaatcacttgaaaccaggaggcggaggttgcagagagccgagatggcaccattgcactccagcctgagggacagagtgagactctgtctcaaataataataataatataataataataatcatcatcatcatctagccagcttcactacaattatgtaggcaacaccaggaaaacactggaatcacagttgataaaaattaatgaattcactcaaaaacattcagagtgtcatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggctccgttggagtcaaatcttcctggtaaacaaagctacactgcagtcatatttggcatatgtgacatataggcccactgcatttccttccaaaggcaagatgccaagggaaggtgccagtaattttatgaccaaaatgacaccattttgtggtgtttgtaagttgaaacaatatatttccctgcattacacaagtttataaaaaacaaacaaaaaaagaggccccagctgtggttgatcgatgatgaattgaatagagcctaaccttccaggcttctcacttgcacaggcccttccaaggtcctgggagggcccctggaaatttttgtagtcataatttttttaatgtttttactagataaggctcaggccccacaaaatcctgaaatcatccctgggttccaatagttacaacccagtaaatctcttgaatgaagcctctatgttattgacaaatactgactggccaagttagcagggttaaaaggtctgtctattttgaatctgaaatccatctcaaagacaggccaagagcttattagtggacttaactggattctgctggcccaagcgcagtaaagtcaaacaaccatatcgaggttttgcattggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcacatattggcttgtctatggcacatcgatatcatgccaagaatgtaagcactaagagagaataagaggaaaatccaggctttatccctattgaattatttatcccactattagaatattagtgaggtaggtgtggccacactgtgatggcaaattgagcttcggtcacaaacatgccttactgttccccccagtctactgacatcagcttcctttacatagcggtagatgcacaaaagtttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcatcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgtagatgaggaagttgaaactcagagacgctaggtaatttgctaaggttcacatggctaataagtggcagaaccacttacaagctttgcaaataattttcaatgcagctcttagttcccctgtaataggagctgaatgatgacaatttggctttgtgtgcattgtgtcttactttctaacttgaataggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaacgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaaaaaggaaaaaggctcaccatttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatagtgggtgagggtctaggtcatctgcttatttctttgactaccttcttccatggaaccagttttccctgacagccttgggattctagcatagatcattttggagtttgtcatttaaatttattttcacggcctgctttggacattttttcagctagagctgttaggatttcagtacatttaagacagtgatgacatgctccagtcctttcatctctgtctcctcagttaatagaaaggaaacatagctcatctatctggacctgtacagaagaatttggagggaaaaaaaaaaacaggcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctgaaaaaaagcttgccacattttacttccataaagataccaaaaaggcgatggactgggagtcagtgcaccttagtttaatgtataaaatgaaggacttgaaccagaaatggaaatggtcatctactgtgaatctaaaaacactcgaggctgggcgcgctggctcatgcctgtaatcccagcaatttaggaggccaagacaggcagatcgcttgagcccctggagttcaagttcagcctgggcaacaaagtgagaccccaatctctacaaaaagacttttaaaaagtggaaacataaatataaataaataaaaacattcatatcatttggtttgtggaaaagagttgctgtagagtcctcaaacttgagccgttgagccagttctcactcagtctctccatggcccaggcacaaccttagtcaagaaaagaatgccttagaacaggaggaaaagaggataatatcgaatggccctatattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgccaagttgtttggctacatactgccttacagtcattatttttggtgtttagaaaaaaatagaaacagggtctcactttgttacccaggctggtctcaaactcctgggctcaagctctccttctgctttggcctcccaaagtgctgagattacaggcttgagatgctgtgcccagcctacattcatttttaatagctgggaggaaagtgggcagaggaagatatagaatgaaggggtagccgactttgtacagagcccaccagtggtcttacaagttttcatgccaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaagaggagggggatcacaaggcaggacaagctgtgtggctcccagcctcgccactgactcactctgatcttggtcaagggagagtgaatcttcactcctcttttttccatctgccagcatgtttggtcttctggcacctggtgttctatacagtacaacatgcttctttgtgttacattgagacttgatccacgtaccatcaacgcagtattataaagtgtacaattcagtggtggttagtatattctcaaggttgtatagcaaacaatcaccattatctaaccccagaacattttcatcatcccaaaaagaaacatggtacccattagccatcactccccagtgctgtcttcccgcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatgtggttgtttctactttattttggcttttatgaataatgctgctatggacatgcatgtactactttttgcgtggacatgtttttaattctagggtgcatccctagcagaattgctagatcgtatggcaactcttatgtttaactttttgaggacctgtcaggctgatttccacagtggctgctccattttacacttccatctgcaatgtttgagggtttcaatttctccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatataacttctttgaagaaatatttattcacatcctctgcccatttaaaaaattgatttgtctttttattgaattataggaatttctttatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgaaatttactcccatgtttttgtgtaagagtcttatcgttttggctcttacatttaggtatttgacatattttgcatcaattcttataatcgtgtgagatgtagggggtccaccttcattattttgcacatagatgttcaggtgacgccattgcactcaagcctgggcaacagagtgagactccaatggagacggggtttcagcacgtttatccgtttatcaggctgctctcgaactcctaacctcagatgatccacctgcttcagcctcccaaaatgctgggattacaggcatgagctaccatgcccagccaataaatgaaaactttttcactcaaaaaaacaacaattgtagtgaaaccatagatcagtttggagaatcatgctattattatctgcttcatgtttacagaatactccgttgaatttggtttgccagattttgtcaagcatttttccatctacattcgtaagaaatactggtctgtaattttttgtgtgtgatgtctttagtttggataccaggttaatatcaccctcatagaataagttaggaaatgttctctcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctatttatgtctctaagaacaatagtaatgtcccctctcatttctagttttaataatttggtcttctgtatttttgcagtgcagtggctcatacctgtcatcctagcactttgggaggctgcggtgggaggattgcttgaccccaggagttcaaggccagccagggcaacatactgagagcttatctctacaaaaaaaatttaaaagttagctgaacgtggtggcacatgcctgtagtcacagctactcaggtggctaaggcaggaggatcacttgagcccgggagatcggtgctgcagtgagccatgattgttccactgcactccagcctgggaaacagagtgaaaacctgtcttgaaaaatgaacagtaagaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttagccgagtgtggtggtgcgcacctgtagtctcagctacatcttaattttataacgttgtagttcagattaattccaactttgtttcaatggtatacaaaaactttgcttctctaaagctccactctcaccccctcctttatactgttattgtcacacattacatctttatataccttatgttcatcaactagatttataattattgcattatgtaagtatctttttcttttttttttttctttattttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccagccagtgctttttatttctttgtgcagattcacgttagtactccttatagggcaggtcttctagcaacaaagtctctcagtttttatttatctagaatatcttaatttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgcagtggtgcaaccactcacaacgttgcagcctccacctcccaggcttaagcaatgctgtcacctcagcctcctgggtagctgagactacaggcatgcaccaccatgcccagttttttttgtttttgttttttttaatttttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgactcttaacgagcatgctgccttcaagcatctgtttaacaaagcacatcttgcaccgcccttaatccattcaaccctgagtggacacagcacatgtttcagagagcactgggttgggggtaaggtcatagatcaacagcatcccaaggcagaagaatttttcttagtacagaacaaaatggagtcttctatgtctacttctttctacacagacacagcaacaatctgatttctgtatctttttcccacatttcccccttttctattcaacaaaaccgccattgtcatcatggcccgttctcaatgagctgttgggtacacctcccagatggggtggcggccgggcagaggcgctcctcacatcccagacgggcatgcccagttagttttaaattttttgtagagacagggttttactctattgccagtgctggtatccaactcctggcttcaagcaattcttgagcctcaagcctcccaaggtactgggagtacaggtgtgagcaaccatgtccagcacctgcattgtttttgaagacaaattagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccatcatttcttcaaatattctttctccttttttctgtttttcttctcctgggacgctcattatgtgtatgttagtaagcttgatgatgtgttccacaaacaggtctctgagattccattcactttcattcatttttatttctgttcctcagagtcaacaatctcaattaaccttcaagttccccattctgtcttcagcctgctgtaatgtgccattgagaacctctaataatttttccatttcagttaccatacttttcaactctagaatttctatttgactcctttttatggtttctatctctttattgatattctctatttgatgagacattgctttcatactttcctttagttctctagtctacagaactgaatcgtttctcttatctctttgaacatattttaaatagctgaattaaatccttctctaggccaggcatggtcgctcgtgcctataatcccagcactttgggaggctgagactgaggttgaggctgaggccaggagttcaagaccaccctgggtaacttcgcaagaccccacctataaaaaataaaaaaatctttgtctagtaagtctaacatctggtccttctcagggacaatttctgcttatttctcccccaaccacgtgtttgggccatactttgtttccttgcatctttcataaatgtttgttaaaaattgaatattttaaataatataatgtagcaattctgaaaatcagatccatgctgccagggtttggtgttactcctgcttgtgttagtagttgctatttatttagtgacttttctgaacttcttctgtaaagtctcgcattatatgtcatgtgttcccactaaagtccctcctcggttagcttaccgatcaggtaatgattaaatgaagatttacttaaattcttggaactgataagtctcctggtttttgccaaggggctctgtgtacatgttggggcataccttcagcactcagctagacaatttacagccatgccttagctttcacttcttgcttgtgcagaacctcaaggtgtcagccagggatgagagtttatgaacttagtaggtctttcctgaccatgctgacagtctgccctatgcatgcgcgtgacattccaaattgccaggaatatgtcttatggacttctagtttcccaagcatatatcagagtgtttcaaattcctgtggacatcttattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctggttggggatgtgggctgttttccaaggcgactactgagctagagggtgaggaatggtctaaggcaagttaacacaaatctcactgttcttacagaaatttttcttgaataaatgctccttgggttgctgcaagactttggttacatttctagagttctgaaaaagtttattgtggtcaattttttttttttttttttttttttttttttttttgctattttttttggtatttgttgcttttatgaagggatgaatttttggatgtctcttttttttttttttttttttttgagacagagtctcactctgttgtccaggctggagtgtagtggcataatctcatctcactgcaagctccacctcccgggttcacacaattctcctgcctcagcctcccgagtagctgggactacaggcgcctgccaccacgcccagctaatttttgtatatttagtacagacggggtttcgctttgttagccaggatggtctcgatcccctgacctcgtgatccgcctgcctcagcctcccaaagtgctaggattacaggtgtgagccactgcgcccagcctgcatgtctttattccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgttctccagcctgggcaacacagtgagtgagaatgtgtctcttaaaaaaaaaaaaaaagtctcattgaccatagactaataaactatttaatcatgggaaatgattaggggaaagacataaaaagagaaactgtaatccacttttttttgctctgttgcccaggctggagtagagtggcttgatcttggctcactgcaacctccgcctcctgggttcaagcaattctcctgcctcagcctctgaaacagctggaattacaggcaagcactgccgtgccctgctaatgagaaattgtaattctcatagaggtcctcccagaggagtagaagaaggttgaaaggcacttctgtatttagtcttctcacaattaaggctgggcccagtggctcacaccagcactttgggaggccaaggcaggcggatcacttgagatcaggagttcaagaccagcctggcaaacatggtgaaactcccatctctactaaaaacacaaaaaatagccaggcgtggtggtgcgtgcctatagtcccagctatttgggagactgaggaaggaggattacctgagcttgggaagaggacgttgcagtgagccaagatcacgccactgcactccagcctggtcaatggagcaagaccctgtttgggtggggaggggaggggagtggaggggagaggagaaaggaaagaaaggaaaggaaagaaaatagaaagaaggaagggggagggaaggaaggaaggaaaaagagagagaaaaagaatgaagaacaaaaatgaaaattttttaaaaacctaaggttaaaataaaccctttttcttcatacagattaaacacgagttcaaattacagctttgctgcttaatagcttggtgacctaggacaagttatctaacctctctgtgcctcagtttcctcatttaaaaatagggcaataataatatctaccacataaggtatttgctgatcacaaatacctggcaacccagtagatactcagtgtaataattattatttttataatttctgcctaagtacaaagataattcttgggttaacctaaaggtagattttcttttatttcttcctgtttcttttatttttcttgttcaccttaaagaattaaaaagaaaatcgattccagcattttggaataaaaatttgcatcaaaatcaatttattcattttattgacatatgaacaaaatgtcatttgtttattcaataaacatttgttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaaaaaaaaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggtagatcacctgaggtcaagagttcaaaaccagcctgaccaacatggtaaaaccccgactctactaaaaatacaaaaattagctgggcgtggtggtgggtgcctgtaatcccagctactcggaaggctgaggcagaacaggagaatcacttgaacctgggaggcggaggttgcagtgagccaagatcgagccattgcactccagcctgggcaacaagagcgagactccatctcaaaaaaaaaaaaaaaaaaaaaatagatgaacaagttgaattatgatgagcaacttgaattatggaggatgctagaaatactgtttcctccacagtcagggcttcctaccaacatagtcacttttagggtttttgacctgaaaagttctgtggcatattttttctttgctatccactttttttttccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattctattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaattaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaggtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaattttttttttgtttttgaaatggaatctcactctgtcgcccaggctgcagtgcagcggcatgacctaggctcactgcaacctccacctcccaggttcaagtggttctcctgcctcagccttccgagtagctgggattacaggcgcatgccaccacacctggctaatttttgtatttttagtagagacaaggtttcgccatgttggccagggtggtttcgaactcctgacctcaagtgatccgcctgcctcagcctcccaaagtgctaggattacagataagatccaccttgcctggcctcactcagtagaattttttttgagattatgctaccatccatgttgttgcacctatcactacagctggccctccatatctgcaggttcctcatccatagattcaacgaaccatggatggagaatatttggaaaaaataaaatatataaaacaacaatacaacaataaaaacagtagaaaatttaaaatacagtataattatgtacataccatttacactgtattaggtacttagagtatacctgaggctgtatacaaacattatgtcatttcataaaaaagacctcagcatctgtggactttggtaactgcagggggtcctggagccaatcccctgcagacaccgagggacaactgttcactcctttttattgctgagtagtattccggttgtgtggaaatgccatctctactaaaaatgcacaaattaggcaggtgtggtggcacatgcctgtaatcccagctactcaggaggctgaggcacgagaagtgcttgaacttgagaggtggaggttgcaatgagccgagattgcaccactgcactctaacctgggcgacagagtgggactctgtctaaaaaaaaaagtaagaaataaaaatgttttctgaagagcagaagtttttaattttgaccagctttaagttagcatttttttcttaaatggcttgtgattttttgtttcttacctaagaaatctttaagaacctgttgtctaatccagcgtctaaaagattttctcctatgtcttctcccagaaatgatacacatttaggtctatgatccattttgagtcaatttgcatatgtgatgtatcttttttattttttatttttttgtagaaatgaggtctcagtatgttccccaggctggtctcggactcctggtctcaagtgatcctcctgcctcacctcccagagtgctgagattacaggcatgagacaccgtgcctggccttctttgcaggatatatatatagatatatatatatataaatcagccaggtgtggtggcacacgcctgtagtcccagctactagggaacctgagtcaggaggatcacttgaacccaggaagtggaggttgcagtgagccaagatggcaccactgcactccagcttgggtgacagagcaagaccctgtctaaaatatatatatatttatatatatgtacgtgtatatatgtatatgtatgcctgcagggccctattgtgagtttgttacacaatttactgcaacttcaattgtgccaccagcccccacaatatggcaagctaaatagagactcagttatgctagggctggttgagggaattttgcaagattagcatggaaagggcccttcatttagcactctgctccgttcatttttgtcaggtcactttcttatcttcaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaactgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagacttgtcagtatactttaaaacaatcctgggaacagttctagattgaaggagactaaagaatcatgtactaagtgtaatgtctgatgtttgattggattctgaattttttaagccatgttatgattaggacaattgtgaaaatgtgtatacggaccgcatagtagacaatgataatatgaagttccattgagtgatgatagtcctctggttatgtcggagaatgccttggttcttaggggctgcacactgaagtcttcaatggtgaagggtcattatgtctgcaactgactctcaaatggttttgtccagaaaatgtatagacatacacacacggaaagcaaatgtggcaaagtattagcaactactgattccagatgaaagttatacaggtgttcattataccatttgaaaatgtttcccagccattctaaggcttaaaggaaaaaaagaaaatgtttaaaataaaaagttgggggcagaaaaagaataccaaaaattttgggctcatgcctgtaatcccagcactttgggaggccaaagagagagggttgcttgtgcccaggagttcgagaccagcctggacaacatggtgaaaccccatttctacaaaatatacaaaaattagccaggtgtggtggcacacacctgtagttctaggtactcaggaggctgaggtgggaggatcacttgagcacaggagacagaggctgcagtgagccaagattgcaccactgcactcagcctgtgtaacagagcgagacccggcctcaaaataaacaaaagaaacacctttgtggcagaggtaaggttgctatacaacaaaatgctgggttacggttccgggtccattccatatgaagatcagaggcttccactggaccccaaggaatactactagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactcactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatcttccatgacattggcattttttaagagtcaaagatagctgtcttgtaaattgtcccacaatccggatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaaaaaaaaaaaaattagctgggcatggtggtgcaagcctatactcccagctactcaggaggctgaatttggaggatcccttgagcccaggggggttgaggctgcattgaggtataattttgccactgtatttcagcctgggtgacaaaataaaaataaaaataaaaaataataattttccccttggtaattaataaataatctgtgggttgttactttgagttcagtgaagatcctgttctcaaatgttttttcacccaaatgtgcatcaatgataatccttgtctgaatgaatttgtattacactgacggttgcaaagtgacacttttaaaaattctgtcattccttctacatttactagctggcattatttcattgaagaagaactcctcctctttctttttcaatatcactcttcgtggattcttctttatattaaatatgtggtaacttattgttgttattcttttgaatgctcaaattgtccagatttgaccaatgcagtctttgttattttttaactccgcaatccaggttaaactatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattccagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcacgagtccagccccaagggaggtggaacagccccacacacagcaggggcctgagaagttagcgggaaacgccgtctacaccaagccttcgttcacccaagagcataaggcagcagtctctgtgctgaaacccttctccaagggcgcgccttctacctccagccctgcaaaagccctaccacaggtgagagacagatcgaaagacttaacccacgctatttccattttagaaagtgcaaaggctagagttacaaatacgaagacgtctaaaccaatcgtacatgccagaaaaaaataccgctttcacaaaactcgctcccacgtgacccacagaacaaccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctctttcagaacattttatagagaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccagctacttggaaggctgaggtgggaggatcacctgagcccagggaggtcgagtctagtgaacggtgattgcaccacggtacccaagcctgggtgacagagtgagaccctctttcaaaaaaataaaaaagaacctgtcagctactcacctggaatactggggttttgaatagttagctctcattctggttttttttttgtgtgtttttttttttagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttattgcagtgtatatttcaggatttttaaaggatcctcgctttcagatctctgtgaattgaaaccaagtgaatcccactagactattttaagaagtcgatataatagcaaaatttctcccacccaaaactatgtcaacaattggatgtactcatcaagtcacccttactctgccactaatttatttccttgttgctgaaatgatgagagaggtataatctccaccctcacggagttgtcatcaccctggagaggaaggagagagccaaaagacatacgtattgtcttgtagacttattagatttacacagtatcatcctccagtgtgtaaggcattgtctaaataggtccagttaaagcactacagagtagccatcttttacaaaaatttttggccacatttttaagttcactggtgaggaggaacgtctcatactctagccctcctgagcctataccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgctaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctggtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggcttaagggatcctcctgcctcagcttcctgagtggctgggactacaggcaggcagctaatttaaaaaatgtgttcgtagagacaaggtcttgctatgttgcccaggctggttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaaaaaaaaaccaataaaaatacaaacagaaagtacaatataacaactgtcaacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtacatgagacttataatgaataaaaggaatcaatacagatttggagatggtggttgttgtcatagataatcttaattgcgttttcttctaaaacagatatgttgtcaccgaaggtcattacaagaagatgaagaaggattctcaaggtaaatattagtctggtgattttttttttcttctcttttgagatggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagggcacttgtctccttcaaggctgatggaaggtaggatatgtgagtccttcctcttaagtggcaggaaacagtattttctcttttatttctttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaagaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtcagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatctgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatgaatgaaaattgtgattccgatgaagcctgccagagaaacaaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacattaaaaaggcaagagaagccctaagcagagtgagcaccagactccacaggttaagggctcagtcacacagaaccatccgcatgtcagaccccaggtgcaaggccaagcatcacctatgcatctgaccaactggctgtaaattggaggtccccacaactccctcctcaggtttgaacatttgctagaacagctcatggaacccaggaaaacagttttcttactagtgctgatttattacaaaggatattttaaaggacacaaatgatgaagccagttgaagagatacacagggtgaggtttggaagggtccttgtggagttggggtgcaccactctcctggaacatggatgtgttcgccaacccggaagctctccaagtcctgtcttttaaggagttttctggaggctttatcacgtaggcatgattgagctccagctctactccccacgccagaggatggggaatggggctgacagcacaacgcttccaaccataggtctttttggtgaccagtccccaaataaggagcccaccaagagtcacctcatgagaacaaaggacgcttctatcacccagaaaattccaagggatttaggagctctgtgtcaggaaccaggtttaaggaccaaatgttagaacaaaagatgtgcaaccataaaaaacagcgagatcatgtcttttgcaggaacacagatggagctagaggccattatcctcagcaaactaagacaggaacagaaaaccaaatactgtatgttcttttaagtgggagcaaaatgatgagaactcataaacaacagacactgggccctacctgagggtggagggtgggaggagggagaggagcagaaaaaactattgggtactaggcttggtacctgggtgatgaaataatctgtacaacaaacccccatgacacaagtttagctatataacgaacgtgcatatgtaccccctaacctaaaaggaaagtttaaaaaggaaaaaacacctaggagaaaagaaaaatgataaattaacaaaggacaatgctcttagcaccgccatcattcaggaatttccaagggttttaggagctttgtgttaggaactggggtcagagaccaaatatatatttcttcttatgttacactaccccagataggaaaacagaaattactctagatatttcaaacaaaaaagggttgtatataggcaattagtgcttatcactggaggtgctagaggtggtgaaggttgtggggatggggttgcaccactggctttcaggctactttaccacagctgatttccagaggatggaagaagtcaggaaacttgggaaaccgctgctgaggtccttgcagccccacggtccccaggctggtgactggtgggggagtatggagtccagctgaccaccagagcctgcacacctgctgctatgggggaggaaaggatgacttctacctcctttccacattccaaattccacgtgactacattttattggcagcaccccgctggcaagtgagccttgatgtgtgcttcctgggcttctggcacctgcacagaaaggggtgaaatgagtgtcacgagcagccaccactctgcatcacacctccacatccaggtgtgctggagagccccacttacacttggagtgtcctggtgccctacccacttttggtaggtgtttgggtgtctgaggctttgcaaaagaagaaggtggggagtctatggtggagtcacatggtggagacctagctaagtcagaggcctggagaggtgtcactggctgggcagcaggtaacacacaatcatcctgagctgattggagaaacacctgggattgattcagagttttttctggaatgttttcactggaatgaaagctgagcggtctgcaggccatatagtattggagaaaacttagccctcattgaaaaaggctgccagagaaaaggtatccacagggaaattcaggagttttgtttgtttttttttctttttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattacaggcacccaccaccatgcccggccaatttttttttttttttctaaaaacagtttcaccatgttggccaggctagtcttgaactcctgacctcaagtgatccgctcaccttggcctcccaaagtgctgggattacaggcatgagtcactgtgccccgccaggaaattcagtttctgaaaatacacctgtggatctctagcctagaaaaagggacctcttttattctttttttttttttttccagagacgggcctcactttgttgcccaggctggttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggccccgcgcctggggatgggaggcaggactgcaccttcacagggacgcttccaccctaccccggaggtcagggcctctcgcccagctctggctctgaggtcctggagggagggagatgctgttgcgactcagaagattgggggagggccacccccattcgagaagagtgaaaatcctgagcctgaagaagtggaaccggttggagccgaggctttagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactggcttacgacatgagagctcaatatgctccttatttaacgcactgttgtatcaggtccctgtgggagccactggctctatagcctaataaaggagcgggtgcacgcactggattggtgagctaccgccactgcaacgcgtcctaatcaaccatcctaaacggcggctggaacaaggttctcgcaggcctgtgcttgggcttgaacgctggtccagccgctgcgctctgtggctccctgtaggcctgcggatcggccagggggctccgttccttttgggcggaggctgaagaagcagcggctgcaccagagaaggccctctgggtgaaggtgggagcgcacggggcccgcggaaccacctaaggcgacttcagacgtgggctcggaactggcagcctttcgtttctgcttcattccaaggccagagcaagccacgtgggcaaacccaaagccaggggacaggaaagtatcctccacccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagcacatagtgctaagtatttggcttgtaatctgtagagactctgccatttggagctgggatctgtccccagagctgtcagacaccaaatcccgtatctactgccacccaaagggacctccagaagaaaggggttatacagggtcaaacaccaaggcaggttagtgaaatttctctagaggccatttaaagctggagtctcaccacctgaactgccctcagaggaaggctgtctagggcacaaacctagtcaggggtccacatggacttaaggacaatttttttttttttttttttttgagacagtctcattctgtcatcaaggctcgagtgcagtggtgtgaactcagctcactgcaagtctcaacctcctgggctcaggtgatcctcccacctcagcctcccgagtagcgggaaccacaggctcgtgccatgatgcccaattaattttcttttaaattttttgtagagatgaggtctccccgtgttgctcagtctaatcttgaactcctggactcaaatgatcctcctgcctctgctcctcaaagtcctgggactacaggtgtgagccaatgcacctggcctcttatgaataattttaaaaacaatgaggttcaccgtcagagcccctgctgctctaccaagtcccttggcccctctcaacagggcaaaagcaagatgagccccagatgttctgcttaatgaccacctttcccaggagactttgctctttaaaggagaaccacttagagatatgagcaaccttaaagaatgccaccagcactagtgaatgccaggcacgggccacgtgggtggagagtatactttagggcagtcactcatggtaaattatttccaccagcccccagaagtgactattcaatgtccaactatgtcaggcccaggctaataaaagtagaggcatgaggaacctagggttgttctgaagtgccttgattatggtacatgtggaagattttagagcttgttgtaaaaagtgatgacccatggccccccaggctgggtctgggattccctttgtggattacaagaggatattatgcagcagtttttaaaaatgaggcagactgggacaatctatctccaagatgcataggtgctgttaagggaacaaagcaagatttagtagggcgtgtatagtatgctactgtgcgctgtgcgttatctgtacagaactgtgaggtctgatacagtagccactagccacatatggctatttacatataaatttaggttggccacagtggctcatgcctgtaatcctagcactttgggaggccaagtgggaggatagcttgaggccaatagttcaagaacaccctgggcaacatagtgaagccccttttctacaaaaaatttatttatttatttatttttattttttttgagacgggtctcactctgtcacccaggctggagtgcagtggcgcagtctcagcttattacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttaggaggctgaggtgggaggatttcttgagcccaggaggtcaaggttgcagtgacctatgactgcaccactgcactccagcctggacaacagagtgaggccctgtctcaaaaaataaataaataggagtttgaggccatgttcacacatcactgcagtccagtctggtaaacagagcaagacgctgagtctttaacaaaaaaaaaaaaatttttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaactggtaatggcggttgccttccgggagggaaactgggagagtgcagggctgtatgcccttttgtacctcttgaatttcatatcatgcgtttgtactaggtgtttacaaattattttaaaaacatactgggaattaggaatccccatatggaatcactgcagtgggacactgattcccaaaaaattactttgcaatttgcctaaaacaaattaagctaatagctatcatgatttcatatttaatattttttcacagcttagagtttttttagctcctgttgctatctctctgctcttatgagctcacagggtgacaaagtgaattagtaagtagcaggagaacattaaaggaaaaactcctgggcaacagggcaaaacgccggctctacagaaaatacaaaacattagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagatatgagccactgcatccaactttggttcttgtttgtctgttttgttttgttttggtttgtttttttgacagagttttgctgtgccacccaggcagtgactcagcctcggctcactgcagccttgaccttctggcctcgagtgatcctcccacctcagcgccaccccccactgccctccaatatctgggactacaggtgcgcgtgaccgcacacagctaatttttaaattttttgtagagatagggtttcactatgtggctcaggctggtctccaactcctggactaagcgatctgcctgccttggccacctcccaaagtgtgagccaccatgcccacccattgaacattgaagctagactgggcaaacccttaagcctaaaccagtaacagtttttcacaagttcatagatgttactgtggttaataacacacaaattcatttaaaagcatgtgtgtccacatagtaatttttggtccttatttttatttttatttttcagttaatggatattaaagatacaactttattttgttttttttgagacagggtctcactctgtcacccaggctggagtgcagtggcatgatcagagctcattgcaacctccacctcctgggttcaagagattctcctccctcagcttcctgagtagctgggattgcaggtacatgcaaccacacctggctaatttttgtactttttgtagagatagggttttaccatgttgctcaggctggttttgaactcctgagctcaagtgatccacctgcctcggcctcccaaactgctgggattacacaagtgagccaccacacccggcctaaagatataatttctatcatgaggaggtccaagaactattctctttttctttttttaatgttagaaagggattaactgggtatgtgctgcagcaaagggaggggaaattaagcaagaagagaagggagccaggaaataaaggccccaacccaggaagcagttaagcaaagttccaggatgacccatgtgacaagtttaggggataacttgagcacatggaggacagaacttggagagggcactgtgggcctgggcgccacctgctccgccagagcactggaagagaacgagggcacgataatggcagatggcactgaaagaaaaggagagagcttgaggcacccttgggggaagcagccatcatcagagtgtattttatttttattttattatattttgagatagagtctcactctgttgcccaggctggagtgcagtggcatgatctcggctcactgcaacctccacctcccaggttcaagtgattctctgcctcagcctcccaagtagctgagactacaggggggcaccaccacacccggctaatttttgtatttttagtagagatggggtttctccatgttggccaggttggtcttgaactcccgacctcaggtgatccgcccaccttggcctcccgaagtgctgggattacaggcgtgagccaccatgcctgacctcacagcacattattaagctctgtggtgaataatatttatatagtcacaattctgtaaacactgttcattttctacaaattgtggcaaacccaaacctcaagaatggacagggctagggtgtaaaagagctaagtccttgccaggtttaccaggaaggcaacagacagtgtctaaaactatgagacagctgggcgcggtggctcacgcctgtaatcccagcactttgggaggccgaggcgggtggatcacgtgaggtcaggagtttgagatcagccttgacaacatggtgaaaccccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaaggagaaaaatatttatccctaataactaatggaccatcttacgccgtctataaaaatatcaattaagaaatcacggccgggcacagtggctcacgtctgtaatcccagcactttgggaggccgaggcgggcaaatcacttgaggtcaggagtttaagactagcctggcaaacgtggtgaaaccccatctctactgaaaatataaacaaattagccaggcatggtgacgggcacctgtaatcccagctactcgggaggctgaggcaggagaattgcttgacccaggaggtggaggttgcagtgagccgagatcacaccacttcactccagcctgggtgacagcaagactccgcctcaaaaaacaacaacaacaacaaaaaacgcggtgatacacgcctataatcccagcactttgggaggccaaggcgggcggatcacaaggtcaagagatccaagaccatcctggccaacatggtaaaaccccatctctactaaaaatacaaaaattagctgggcatggcgcgcacctgtagtcccagctacttgggcggctgaagcaggagaatcgcttgaacctgggaggtggaggttgcagcgagccgagattgtgccactgcactccagcctggcgacaaagcgagactccgtctcaaaaaaataaaaaagaaatcagaaactgttcaaattccaatctatacaagtgaaacctacacagttaaatgtcttaatagagagctaaaagcattaagttctgtcatactcaacatactgatgaaaaaaatttgaactaaaagacagcctgatctttagaaactggcagaaaaaataggggctgcatccaagaccactcacggcacgtccattcttccagcagctcccaactgctattttatgaaaagtccaaatttcccaccccaaggtcctagagtacagccagctccctaccatcaaaaacaatagctaccaaaactcagtaaaattaggcttgttatgaagagaagattgaagaaataaaggtatttatttcatcttggtatttgaatgtggaaactcccagtagggtaagaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaattctctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctttcttctacaaactatatttcagggaaaccaaatatttgatgagggaattctttgtttagaaggattttagctaataaatgcagaggaataacaagatttaggaggggggagaaatcaccattttgtgacttctaataaaataatgggtctaggcaacagttttcaatggatgctaaaacgattaggtgaaaagttgatggagaattttaattcaggggaattaggctgataccatctgaaaccatttggcatcattaaaaatgtgacaacctggtggctgccagggaggaaggggagagggtgggggaagaacagaagttatagtttatgggcacaaagttttggttttacaagatgaaaatagttacagaaatgaatggtggtgatggttgcagaatattatgactgactatacacttaaaaatgtttaagatagagctgggtgcagtgttgcacacctgtagtcccagttatgcaggaggctgaggtaggagaaccacttgagcccatgagttcgagaccagtctgagtaacatatagagacctcatctcacaaaaacatcactaccacaaaacaaaacaaaacaaattgttaagatgctaaattttaacttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaaaactagccggacgtggtggctcacgcctatagtcccagctactcgggaggctaaggcaggagaatcacttgaacccaggaggctggggttgcagtgagccgagactgcaccactgcactccagcctggccaatagagggagactccgtctcaaaaaaaaaaaaaaaaagaaaagaaaacatagttacccagcaattccacttctaggcatatacccaaagaactcaaagcagggactcaaacagatacttggacatgaatcttcatagcaacactattcataatagacaaaaagcagaagcaactcaagagtccatcgatagatgaatggataaacaaaatgtggtatatccataaaatagaatatcattcagccataaaaggaattaagttctgatacatactacagcatagatgaaccttgaaaacattgtactaagtgaaagaggccaggcagctaaacttccaaagactaatatacaattccactgaataggcaaattcatagacagaggatagaataaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaaaaataaacttgtaaattttatattatatatactttgccacaataaaaatttttttaaaaatgtctaagtgtgacaaccgaacttctgtgttaggataggaagaatacttatgaagtattcttgcccctgaaatgaaccaaaatctaatcaagtctctagaataaacaaccagttcacaggaaatccacagatagccaagcaagttagatggcaccataataaagtaatcaaccaaatccagaatgtggaataagcagttaaaaaaaaaaaaaaagggggggggaggccaggcgaggtggctcacactatggtctcagcactttgggaggccaaggtgggcagatgcttgagcccaggagtttgagaccagattgggcaacatggtgaaaatccatctctataaaaagtacaaaaaaatttgctaggtgtgatggtatgcacctgtggtcccagctacctgggaggctgaagtcagacaatcgcttgactccaggaggcagaggttacagtgagccaagattgtgccactgcacgagaccctgtctccaaaaaaaaaaaggaaaaaaaaaggcatagagaaagaacaactgctgtagaataaaagactaaagaggcaaaacaacaaaatgcactgtgcgaactctgatccagatgcaaacaaagcagatgtagaaaagatgtagaaaggatactttttttttctcttttttttttttttttgagatggagtctcgccctgtcgcccaggctggggtgcaatggcgcaatctcggctcactgcaacctccgcctcctgggttcaagagaatctcctgtctcagcctcccgagtagctgggattacaggcatgcaccaccaagcctggctaattttttttgcatatttttagtagagacagggtttcaccatgttggccaggctggtctccaactcctgacctcaggtgatccaccagccttggcttcccaaagtgctgggattacaggtgtaagccaccacactcagccaggatacatttgatacaactggagaaattagaataaggactaggtgctagatattaaagaattattattaattttggagatgttataatagcatgaagattttatatatatatatatgccttatcagttggaaatgaacactaaaggacatatgaataaaaggcatcatgtctgggatgggcaaaatgcttataactgttgaggcttggtgatgggtacatgggggttcgttatgttatcctctctgtctttgtatttgttttagattttccactaaaaaagttaaaaaaataaatgcactactttgagaaaaaacattctaaaatctatagcctggaaaagataactgcaaatagagttaattgccaaaggtaacagctaaaacaatgatataaaatataaagggacagtcgacttgggtatttcatctggaaagactgacgaatatgtaagtctttactatcaagtacatgcaggagaatcttcaaaacaaacagactccaaataaattctaaaatgagaaatttgtagattccatatggttaatattttacatgaaaatcggggtgtaaaaactatagtcagccctctgtatccacagattcaacccaccttgaaccaaaaatattaaaaagtaataacgcaggccggacacggtggctcacgcctataatcccagaactttgggaggccgaggcgggtggatcacctgaggtcgggagttcgagaccagcctgaccaacatggagaaaccccgtctctactaaaaatacaaaattagccgggcgtggtggtgcatgcctgtaatcccagctactcaggaggctgaggcaggagaaccacttgaacccgggaggcggaggttgtggttagccgagatcgcgccattgcactccagcctaggcaacaagagtgaaactccgtctcaaaaaataaataaataagtaaataaataaaaataataacgcaacagtaaaaaaaaaaaatacaaataatacagtctaactatatagcatttacatgctagtagacataagaagtaatctagtagtgatttaaagtagacaggggggctgggcacagtggctcacgcctataagcccagcactttgggaggccaaggtgagcgaatcacctgagatcagaagttcgagaccagcctgaccaacatggtgaaaccccatctctactaaaaatacaaaaattggccaggcgtggtggtgcatgcctgtaaccccagctacttgggaggctgaggcagaagaaccacttgaacctgggaggcggaggttgcagggaggcaagatcacaccactgcactccagcctgggcaacagggcaagactctgtctcacaaaagaaacctccccagtaagtataaagagaccctaagagaggaaatggctgacagtgtaaatagagcagagcaccagaaggtatcacttcaagcatccgtctttagagacatttcacagaaacagtatcgaggctacaaaccgaataatctttaccttttgtgttctggaaaaaatgctgccacagaggtctgattttgaagtggctgccaacatcccagacagcgaaggtgttatttttatattctactgtctccacacagaaacctaaatgaaacatggggaaaacatttaattatgatttgtgctggttgaacaattcaaaataatttcaacatgcggacagtacttttaatttacaaagcagcctgctagtcaaagatctatagccttcaaagagaatgtgctggccccctcgcccattcatcaggacaggtgtctcaaaccttctctactctccaatctctagccacgcacctgccctttctctcagcaggagactatcacagtgtacttcagagcagagaagccgccgatgggaatgacttccacttccaccatacagtgtaaaagccagtctacatctttacccatgcttttcttcctccctcttggaacaacagaagaaggtaactctcttccaccaactccctccctctatgagccagatccaccctacccagactgtctggaactttttactattcctattctctcccatatctgaatatctccaatctgttcaccttggcatgcttaagccttttacatctttaaaaacaacaaaacaaacctttccttgatccccacatcttcatcgcactctcttccttcacatcttcaccctctatttgctttttttttttttaagagacagggccttgctgtgttggccaggctggagcacagaggtacaatcatagctcactgcagcctcaaactcctgtgctcaagggatcctcctgcttcagcctcccaagcagctagaactataagcatgagccaccatacctagctaaatttaaaaaattttttgtagacacagggtctcactatgttgctcagattggtctaaaactcctgaggtcaagcaacctgtccactaagctttcttcggtcctctcacgcaacagcaccttagctctgctccaccattgggtagctggttttcagtaaggtcagcagtgatcaccaggtcaataaatctaacacaggccttctcagttcttccataatttgatcttctatctgacgctactgctcactccctccttgacacccttccccagcttcccttttccttctatctctatggctgtactgtctcagtctccttagtgaactcagccacgtttaactgatcctgcaatgatgggagtcgccctggctctcactggccccatccactctcctctttctgcacccctccctaggcaatctcactcactcccacgacttcattcctatctctgtactaactctgagatttatatcccccaacctagccctctctcctgagcttcaggctcataatctaacagctttggcaaatgtcttcaaggccccaaaacaaggtgatcagtcaaaaatggaatttaaggtccctacccccaacctcctcctctgctagttatcccatcattgacttcgttccacaagctgatagcctgagaggtgccctggaaacatccgatgctcgcacccctagaaccctactaccacaccttatcaattcaaccccttcaacaactaatagtcaccctaacccaacagaccatcatttctagcctcaattcctgaaaccatataactaatttcacctcagccactctccctctctccatccggtcaccatcttctaaacaaagcaatagcttaaaaacacatagtgtggtcacgtcatttctctacacatttatgtttgattggaatattttcaaacttaaaaaagaaagaataatcgccccaaaaaataaaattaaaaattaaaaaaaaaagaaagaataagccgagcacagtagctcacacctgtaaccccagcactttgggaggctgaggtgggcagattgctttgagctcaggagtttgagaccagcctgggcaacatggtgaaaccctgtctctacaaaaaaacacaaagattagccaggcattggtgccgtgtgcctatagtcccagctacttgggaggctgagacaggagaactgcttgaagcaaacattgcagtgagctgagatcacaccaccgcaccccagcctggatgacagaataacatccaagaaagaaaagaaagaaaagaggaagagagagacagagagagagagacagagatgggaggggaggggaggggaggaaggaaaggacagaaaagggagggagggagggagggagggaggaagggaggaagggaggaagggaggaaaggaaaagaaggaaagatgtccccttagcggcttcccacacccaaatcccaaacatgactgtcaagacccaagcaagctgggtctgctcaccttccaaacctcaattctagtcatgccttattttagtgagagacactcgttacattgcaacaatctaaattcttgctaaataaataaatacaatgccattccaatcctataatgatggtaggggcaggggcaggaaacttagcaaaattatctaaaatttaacctggagaaataaacaagtaagcataaccaggaaatctctgaaaatgagtaatgaattatttttaaggatatgccaagccctagtaacacttgaatagagttcaaatataaatgcaacaggtacttgcccaaaaaaagacacacataccagtgagaatttagtatgtaacaaagaaggcatttcaaatcagcatggaaaaattattcaataaatgacattgaacaactgtctaccccagcaccgtccaatacatagtcactagccatttgtgactatttgtttatgtttttgttttattttgttttgtttttgagacagagtctcgctcttgtcacccaggctggagtgtatggtgcgatctcggctcactgaaacctccgcctcccggattcaagtgattctgctgcctcagcctcccaagtagctgggattacaggcgcctgccaccacgcccattttgcaattttagtagagacggggtttcaccatgttggccaggctggtctcgaactcctgacctcaggtaacccgcctgcctcagcctcccaaagtgctgagattacaggcgtgagccaccatgcccggcctatttatttattttttgagacacagtcttgctctgtaacctaggttgaagtgcaatggtgcaatatcagctcactgcaacctgtgcctcccgggctgaagtgattctcctgccttaacctcccgagtagctgggattacaggtgcatgccactactaatttttgtatttttagtagatatggggtttcaccacgttggccacgctgatctcgaactcctggtctcaagtgatcttcccacctcaacctcccaaagtgctgggattataggcataagccactgcgcctggcaacgtggctatttaaacttaaagttaaaatcaaaaatcaatcaataaataaaaataaataaaaaataaacttaaagttaaatacaattaaaagttcagttcccggctggacacagtggctcatgcctgtaatcccaacactctggggggccaaggtggacggatcacccgaggtcaggagttcgagaccagcctggccaacagggtaaaactccgtctccactaataatacaaaaattagccgggtgtggtggcgtgcacctctaatcccagcttctcaggatgctgaggcagaagaatgacttgaacccagggggcggatgttgcagtgatctgagatcgcgccactgcactccagcctgggtgacagagcaagattccatctcaaaaaacaaaaaagttcagttcctcagttgcattagccacatttcaagcacatgaacagtcacatggctattggctacgacactaaacagcacagacacagaacattttaatcactgcagaaagtgcctcctgggcagcactggcttatccatttgaaaaatttaaccaaattactaccttacacacaaccatctcataactcgaacattctcctcggtttcccactcctcaatcgatgcaatctctgcagctactgcccaagttgaaagttgatcatttggagaccaggtgcggtggctcacgcctgtaatcccagcacttagccgggcagatcatttgaggtcaggagttccagaccagcctgcccaacatggtgaaaccctgtctctaccacaaatacaaaaattagccttgcatggtggtgaacgtctgtaattccacctactcaggaggctgaggcatgagaatcgcctgaacccaggaggcggaggttgtagtgagccgagatcgcgccactgtacttcagcctggggtgacagagcgagactctatctcaaaaaaaaaaaaaaagaaagttgatcatttgagtcctgtgcctaattcaatattcagaacagaacagtagtaatgttcacatgccacctgtggggtgtatcctcagtcagaagtttggatctagaggcagttcacaaggcaaagattcagttctgtcaaaactcgctttgtaaatctcttaacaagccggtaaaacacagtgctggttcacagtaagagcagtgcagccagcttgtctatttctctagttggacatcatctcaagcagttggtttgagccagagtgaagaaaagaaatcacactccatctctaagcactgggagcgtacttggtgtagagatgagatgctgccactaaggaaggccagctggaacagaggctgactgaggaggcaccagcagattcccagctcccacctcagccttctgctgggacactagctgcgaggaatgaggggcagaactaccctccctgttttgcccattatctttttcttttttgccaagcaaatggggttaaatttgcttagcctccatgtgttcacatgtctcccttgtgaacctaagaatgtgcaagccactagaaaaggatacataacctggccaggcgcggaggctcatgcctgtaatcccagcactttgggaaaccatggcgggaggatcgcttgagcccaggagttcaagaccagcctaggcaacatggcaaaaccccgtctctactaaaaatacaaaaattagctgggcatgctggtgcacgcctgtagttccagctactcaggagggagatggaaggatcacttgagcccaggaagttgagactgcagtgagcagagatgtaccactgcactccagcctgggtgacagagtcaaaaaaaaaagaaaaggatatatataacctggtttttggcctctaaaaatgtatgctcatggagtagacaagatttttaaaaagaattattcaataacataagaagcatgtaaaaataaaacatatttctctggtgaaacagaacctaaaaaatatatataacatactaaattgtaaactggaattgccacaggtctttcattaacttacctactgtagggacggcaggcacagtctcccccagcttcaatttatacaagatggtggtttttccagctgtatccaaactcaatataagaatccgcatcttttttttcccaagtagacttttaaagagcttttcaaaaatgtttcccattgtaatttaatcgaattctgtaacatgacaagaaaagcaagccaaataattgttctctgcagagatatagaagcaacacgcagaaaatacaagtgtcaattagaaatggctcccaggaaaaattcaacaattttaggtacactttggccaatgagtagtgagtcttgtcttcaaagggaaactcaactaaacctttccatgccttaccagaaaattctattttccactgcagcatccaagagggatatgcaacatagcctcagcactgctatgacagtggcagcctttagtcatttagtacagaagtacaaggccaggtgcggtagctcacgcctgtaatcccagcactttgggaggccaaggtgggtggatcacctgaggtcatgggttcaagaccagcctggccaacatggtgaaaccccgtctctactaaaaacacaaaaattagctgggcacggtggtgcacgcctgtagtaccagctactcaggatgctaaggcataggaatcacttgaacctggggaggcagaggttgcagtaagccaggaccacgccactgcactctagtctgggcaacagagcaagactgtctcaaaaaattaattaattaattaattttttttaaaaaacaagtacagaagcaatgatacaacaaatacaactatacctcattctaaactctactgaaatgagaatttatgaaacagagaagctttttattttatgcaatataaaacaaagtctttaagacaggttaaacaacaatatcccttggaaacgtagtagttccttatggctagcagacaccttggaaataacctaagaaatttcagaggcaaagaaattcagcgttgggaagcttcactgccaagagagataacttggcagagttgaggaggcaccacagcatccagttttcgtttgagttttttgttttgttttgagacagggtctcgctctgtcacccaggctggagtgcagtggcacaatcacggctcactgcaacctcaacctccccatctcaaacaatcctcccacctcagcctctggagcagctgcgaccacaggcatacgccacctcgctcagctaatttttgtattttttgtggaaatgaggtctcactatatttcccaggctaatctcgaacccctgggctcaagtgatcttcccacctcagcctcccaaagtgctgggattacaggcgtgagctaccaggcccagccagtatccagtgttctattgctgtaactatcaccttactctcaaccagttcttagaactttttatttaagtataatttacatacagatataaacatacatgataactgtaaagttcaatacattttcatgaaccaaacacacctatgtaaccaaatcaagaaaagatgatttatcaggctgggcacagtggctcatgcctgtaatcccaacactttgggagaccaaggtgggtggatcacctgaggtcaagagttcgagaccagcctggccaaaatggtgaaaccccgtctctactaaaaatacaaaaattagctaggtgtagtggcacacacatgcagtcccagctactcagaaggctaaggcacaagaatcacttgaacctgggaggtggaggttgaagtgagccaagattgggccactgaactccagcccagggcaacagagtgagactccatctcaaaaaaaaaaaaaaaaaaaaatgattatcagaccaattctccttgtgcctcctcccagtcattactccataaaaggtaatcactatattgacttctaacagcataaatgttcaatattttatttttcagtagaaatcatggtaggttatataaagtaagtcaatagtaaagtcagactaacttacagaaatttacagtctctttgagatcagcctacttgaaatgtgagcttgacattctaagtaaagacttacaagcagtgctgggtctacacctctaactaagctcttggaagtctgtaaagatcttcagaccaggcagggtggcttacccctgtaattccagcactttgggaggctgaggcaagagggtcactttagtttttgcttactgagataacagaagacaagggaggattgctttaggccaggagtacaagaccagcctgggcaacatagcgagaccctgcctctatttttaaaaataataaaacaaaaaaaaattcaaaaagaaaaagacatacatccttgttccagagactgtgatttattttctttttaaattgctaaccaaagaaagctttactcctgggcaggggaggaggaagacacaaggaggatagccaatctcccattcattcggactctggtaaccacagagcggaggtaaccaaattccacaggcctcaccgctgaaattcaacagtggccagcagtagcttaatatcatggattacgcccaagtacacaacattcctttctaggatgagagaaagcgagcacagaatttatcctgttcacaaatgtggcgtaagtgaccaaagaatgataaatgttttaatcattcaaagaaagtccattataggtctataaaagtccagtgcattgcagcactcaaaatcttgccgggcgacaaaactagagattccttttctttgtttcgaaaaacaaatctcacagatgaggagacttttcaggaacatgctgggggagggaaggtacttcccgctcagatgccccttgaggcagctagtcccaattccccctgccaaccgcacagacacaccaccttgacctccctctcccttctctttcctcttattgctactcatgtgccccaggcgcccgtggtcctgacacccctgcgccgctggagacccctctaaggtaagatggctccgactacagggcctttttggcacgctcagtctcccagccccaagcgccaaaagtgcattagggagaaacgtcggcacgacgtcaagggcgcgaacaagcgtggtggcccaggtgagcgtgcgcggcagccaggcacgcccggctcccggggaaagacgccccttttttgccccggctgccaggccgctccttctcaacttgtgcgcccctggaagagcaaagagagggccctgcgtggaacctatgaagcctccttcggttcctcgctgctccggccctagagagggcgaagaaggaacagcggagcccaatccctttccgaaagccaccgccgccctccagtttctggcccgcagacgaagtggagatccagccaggtcttgagtgctgccgccccatccctgcagccggagactcacctgttgccactcaaggtaccgctacctacaacaccgccgactccgcggcctttaggatttcagctcagttcagctaaaccacgacaggcgtgggggcaggaacagcaaccaaccaatcacccaccgcctcctggagcttttgcaccaatgagctcgaagttttgtgagtgacgacatatctggccaatgcaaagaagagtaagggcctgggagggagggagcgccgtaggcgacgccatgaagctctggcaataccatgttcatcttcaaatcacagttaaacgaattctggcgagacacgcccacgtcccccacccccgatgccatgtgcgaccaatcagaaaagcaaaaggattgtctatttgcacggccaatcagctgggaaaatcgccgaggtttgagctaacctcggagcgtccacaccaaccgggaggggacatgtgggccgggccaagttaatagtgccatggaaggaaatttaccgcggttgagttaaacgtagacattagtttggggcggtgttccgcgtaggaaataccacacactgacactgaaattaggcataaggaagttttcctattccgcctgaggctagactgccctcccacctctacacagattttcaagttggggaaaatactggccacccgcacctcgttaagacgtcgcagaaccagtcctcgtttccgagaaatgctttctatagtcagttccctaaatgcccaacttgttagctaaaaaggttacaaacgcctgtaaatggtacataactgaaatcatcagaacaacaaacatctattaaacatatactatgtgccagaaactatatcaagaacttcagcaggcccggcgcggtagctcacgcctggaaggccaaggctttgagctaggagttcgagaccagcctgagcaacatggcaaaaccccatctctgcaaaaaaaaacaaatttaaaattagccgggcatggtagcggctgtagtcccagctactcgggaggctgaggcaggaggatcacttgagcccaggaggtagaggctgcagagagccgtgatcacgccactgcactccagcctgggtgacaaagcgagaccctgtctcaaaaaacacgaacaaaaaaagttagaagatactgctagaattgactaaataaataaataaataaataagaaaaacaatgttacctgcaggaccgtaacgcccagtgaattacaaactattatccctggccagacgtggtggctcacacctgtaattccagcacactgggaggccgaggcgagcagatcacctgaggttgggagttcgagaccagcctgaccaacatggagaaaccccatctctactaaaaatataaaattagccgggcgtggtggcacacgcctgtaatcccagctacttgggaggctgagacaggagaattgcctgaacctgagaggcagaggttgcagtgagccaacatcgtgccactgcactccagcctagacgataaagcaagaccctgtctcaaaaaaaaagaaagaaaagaaactattatccctgctgttttacagaaaaatattaagtagcctgggtctgtcccactcccacaccttaatctttttctttctttttccttttttttttttttttgagacagggtctcactgtcgcccaggctggagtgcagtggtgcgatctcggctcgctgcaacctttgcttcccaggttcaagtgatcctcctgcctcagcctcacaagtagctggcattacaggcatgtgccactgcgcctgcctaatttttgtatttttagtagagacagggtttcaccatgttggccaggctggtcttgaactcctggcttcaagtgatccacccacctcagcctcgcaaagtgctgggattacaggcatgagccaccgcgcctggccaccttaatctttttaagcaaatacagaatggaaactgccctcacaggattaaggagagttacaagccaggctttaggcagcattatatatagttagctgttatccagggtgcacaagtgtactttgacccacttccctgcagctgctaactcactgaacatcactccacgtgctagaccacctcctacctgtttctccatggttcttaccatgagtaagaatttctgacgctagactcataagatcgttttgcccaagaacgggttgtttttcagatcctgaattctgacgtccccaaccaaggaacccactcagcacaagaatgaggtttcttggtctccctgtctcatgacttcgcccttcacttcttgaccaatcatcgatccccacactgcagcccctgtccagaggacttaaaaaccctgccccccaaacctctcagggaggtggatttgaggcttcttcccatctcctcattcagatgccctgtgattattaaactctttctttgctgcagccaggtgtctctgtatgctgactcactgtgcattgagcaaacaaaactattaaattacagtactacttactcttctaattacagtgcttatatgtatgagggttaatataaatacatatgactccttaaaaattaaagtatgttttttctgactataaaaattatacataaccgggtgcagtggctcacacctgtaatcccagcactttgggaggccgaggcgggcagatcatgaggttagatcaagaccatcatggccaacatgctgaaaccccgtctctactaaaaatacaaaaattagctgggcgtggtggtgcattcctgtaatcccagctacttgggaggctgaggcaggagaattgcttgaacccgggaggcggaggttgcagtgagccgagatagagccactgcactgggtgcagagcctgggtgacagagtgagactctgtctcaaacaacaacaacaacaacaaaaaactcatgctagtttaattttcatttatttgatgacttgctatttttccaaatgtttactagtatttttatttcatctattagaaatgatatattcatgtcctactgacttccaagggaaagatagaaagttgttttgccaggaactatgaaggttgtttgaatggagtcatcataacctaaaaaaaaggtgaaataacgaaggtgagatttttacttaccattgtttgttcctacagaaggaatgctggagctgataattatgagaatttatccttccatccctcatagcctaagaatattcattattttcccaatatctgcactgagcctgtaaaccaaaatgtatctgagacatgtctcaatcaatttacaagtttattttgccaaaattaaggatgcttacctgggagacaggcctgtgcctttttccaaaggtgattttgagggatttagtttggtttgtttgtttgtttttgagccagagtctcactctgttgcccagggtggagtgcagtggtacaatcttggctcgctgcaacctccacctcccaggttcaaatgattctcatgcctcagcctcccaagtagctgggattaacaggcgcgtgccaccacttctggctaatttttgtgtttttagtagagacggggtttcaccatgttagctaggttggtctccaactcctgacctcaggtgatccgcccacctcagcctcccaaagtgctgagattacaggtgtgagtcaccgcgcccggccagaaggatttaatattttatttatttatttatttatttatttatttatttttatttttgagacagagtcttgctctgtcacccaggctggagtgcggtggcacaatctcggctcactgcaacctccgcctcctgggttcaagccattctcctggctcagccgccccagtagctgggattacaggcgcacaccaccatgcccagctaatttttgttgtttttagtagagacggggtttcaccatgttggccaggctcgtctcgaactcctgaccttatgatccacctgcctcggcctcccaaagtgctgggattacaggcgtgagccacggtgcccagcaaggatttaatatttaaaatggaaaagcaggctggaagggaaagaaggagagtatggtcacattactgaattcacatgttgcaagagacaaggagcaagtaggggaatagtcaattatgtattactctcgtgcttaccataagataaggtggacatagagtagttagctgcagtcagtcctgcttaggaatgaaaggaaaggcaacttcttgcatgactcagctttcagcttaattttttttcttttggcagaatgaattgggttcccaagtttttattttcctttcacaagcctctgaataaacaaagttcctgcccacatggcattcaattgctaaacaattataatcacataaatacatacacatatacgtatatgttttatatatatatatatatatatataatatatatttaatacatacgtccgggtgcagtggctcacacctgtaatcctagcactttgggaggctgagttgggtagactgcttgagccaaggagttcaagcccagcctggtcaacatggtgagaccccatctctacaaaaaatacaaaatacaaaaattagctggtcatggtggtgtgcacctgtagccccagctactcagaagactgagatgagaggactgcttgagcctggaaggcagaggttgcagtgagccaagatagtgccactgcactccagcctaggagacaaagtgagactctgtctcaaaaaacaaacaaacaaaatacattcatatagagagagaaaaagagggagaattttataatgatatgcatgaggaatgtataggggaagaggctaaaaataggccgaacttactagtgaatatattcaggaggtaggactgtgattgtttttaagtgatcgagggaaaatagtgtactgattttaaaatggaaaactcaacttattttttaaaaattaaaactctgacaagagggaggtttaattgaaatcacagtggctgctcagggaagtttataaatctcgaactgcaacgactcaataagcatgaattgcttgtgatgatattgacttaatagagttattttttccttaatagaaaacacatcttatcaatataatgttatttgtaaagcatggaaaggacaaagtgctcttgggagaagtagaaagagaatttcactctgagaaacctatttggagaaagctcctcatctctggcttagactttaaaattagttaatagtgtaattagggatagttgtagtaatagtggtattggtatggtagttagagtttaaatgtcacacagaatacccagaccaccttcccccaagtgccactaaacttattcttctaatcaaacctctgctcaagggatgtcttcttcctctcttggaaagctgtgttccttacctcagaaacagccctccataaacctgcccttaagagaatccttggccaggcacagtgattcacgcttgtaatcccagcactttgggaggccaaggcgggtggatctcttgaggtcaggagttcgagagctgtctggccatcatggtgaaaccctgtctctaccaaaaaataaacattaaaaataaaaaaattagccaggtatggtggtgcgtgcctgtaaatctcaactacttgagaggctgaagcagaattgcttgaacctgggaggcagaggttgcagtgagctgagatcgttccactgcactccagcctgggcaacagagcaagactccatctcgaaaaaaaaaaaaaagagagagagagagaatccttaagacacgccttcttggatgccctctggagaaatgtcaagagtagccaatatagtcaccccagtcggctgtggtgtgtgggcctctagtgttttaaggttctaggcaacttagcccctcccaggagatgctgatttacttttctcaaggtgcataaagtctcatcacaccaatatctgaaaaatctcttttcaaagagatgcaggcagccttccagccccatgatgttaatacacagggttaggcagcctggcaagtgcactggggcccccactgaaggatcatctggtttccatagcaacagtccttcctttccacggaggattctatcatctctcctgctcactcaggctttccagaatgaattgttttttgtgactataggtgtttgtccttgatcctgcaaagagaaaagacatattcatttaaaacaaacaccccccaccccgccccgcaactgactgcagctagaatactgcattgcatcagctggtcttcctttcatttaaaaattccatgtcctttctccattttgctccgttctctagctttatccatcattttagaaaacaggtttctctgacagaaaacaaacagatggcaactccatcatcctaaaactggctgtgacggggctctaaaattaagtgttcatggggctcccagaaagcctaggcttgcatggtatgtgtggctgacctgtgagttacgattggaggggcaagagaaggctttctatacacagatggctccccatacagtgtcacagtctctgaagtgttgccttttgaggtttgttttcttaggtcaggcactgctgtcctgtcagtattttcctaaattgccaatactcctgggaagagtaatacgttaggttactaatactgaaagaacttgggaaagagaggagggggtgcagcgggaagggaataaaaggggctctgaagaccacctttgtgtgcttcacagtgacatcttctgcaagaggggaagtgcaggtcttcatctctctctttgtctctctctgtcacacacacacacacacacacacacacacactgcaggatgccttctgacaattacaatacagtagtgaattcaccgaacaggactgttccctgaaacacctacatacaatcccgctggaagacctttgaaacagccctgcagtgactaaaaactctgtccccagtgccacttgtttaaccctacagtttccacagactaaaggtagttttcctttggttaatatgaaaacaccaaatagtcagattgctttgttaaataaagtggattacggtgaatctgttcacttctatgttttatattgccctcactccacaaatcacagaagatatttatttttcccccagttaaattctgttaccacaaccattacaaacaaatgtctatataaccaaaatgttagtcagccccattccaatggagcacattttaagtgatgtttaatgggacataatttgaacataaaattctatctgtgcactgttttcaagtctttgaatcaggcctccacctatagatgttggttacctatcagggagcaacaggtgatgctaaggatcactttgtaaaaaccaggaatcacatccctgtaactgacaggaaactgactatattcatcagggttctccagaaaaatagaactaacagaatgtgtatatacataggaggaaattttgtttaaggaattgactcgtgtgatcgtggagactttgggagcccaaaatctgatgggagaagctggcatgcaggaggcccagggaagagttacagttctagtccacaggtaacctgctagagaattccttcttgttctggatgagtttggccttttgtctattcaggctttcaagtgattggatgaggcccacctacattatggagggcaaccttctttactcaaagtctacagatttaaatgtaaatctcatccaaaaacaccctcacagaaacatccagaataatatttgatcaagtatctgggcaacatggccaagccaagttgacacagaattaaccgtcacactggatcacaagggctgtgttcagcaagaactgaccttggtcaaaccctgcccctgcccttatgccccactcttcttcattctgggtcctgctatttccattttatcatgtcttcatcttctttccccacctttcaggtacctttcctctctgaccctatccctagactcacctcctaccccccactcaaagcccttccttccttaaaaaatgatgttagtcattacactttaggatttaaattaatcattctgttagccgtcttactaactttctcactgtgaaaggaaagcatattaaaagaatttcagggatcgacgaagagctgagggaggtatttttctaggaagagaaagtgactaacagaaatcaagacaaagggggacaatcagatttttcagatgacagaaagcaggtaaactctagagatctagagaactagcaaatggtctcttcagggtgtcatcattgcagtaaatgagctctagctatttctgtctttattcttcagggtattcaagattgcagttacttaggagagacagagcatctgactgattgaacttgggttctgtattcactcctgggccagggggaggcagggtacctggtctgacagtccttccaaggctgcatgaaccagaggagctgttaccagaaaagggcagagtgaatttggggcagcaaaaacatttattgcttatcgactatcactgcaaggattactcagagggtgatgcagaatcagcacccctctatttctaagatgaccttgaatgtcagagcaaggcacaaacaggttgcagagacatgtggagtatctggagcactgtctcaggatccttcctctcctgctggatgctaaggaccttaaggacaagagctatctttgcttgcaatttatttggcaggccctgcagggctgtgcaaatgattctatttaatttttactacttgtgagaaggcacagagggctttgagagggcacagagggcctcttataatgggtagatatgcacattagctgatacactggaaactttccagcaggcatatccttccaagatgataaatattcctccttgttggagaaattgaagacatttgtacttgcaatctagcttatctagtaaaacaagacaaactaaccagtgatagggagaaacatgtttgcattattttccaaccttgaaaataatgtcagattattggactgagaaccaatgtcatcttctggatcttgtaattatttggacaaaatctctttgattctaggttcaaagtcaaggtgtcaaaaaaaaaaaaaggatacaactgttaagcttatttaattatacctctcactgtacaaataaggaaactaggccaggcgtggtggctcacttctgtaatcccagcactttgggaggacaaggccagtggatcacctgaggtcaagagttcgagaccagcctggacaacatggcaaaacgctgtctctactaaaaatacaaaaattagctgggtgtggtggcaggcgcctgtaataccagcgacttgggaggctgagacaggagaatagctagaacccgggaggcggaggttgcagtgagccgagatcatgccactgtgctccagcctgggtgacagagtaagactgcgtctcaaaaacaaacaaacaaaaacaaataaggaaactgggctcagagagatgaaggtacacaggtgatgggtagatagggacaaagaaaagaacctaaccctttggactccccaagccattctaatatttgtttttgtaagttagtagcttctgcacgttagtatgtcagaactcaactagtttcctatctttcctgataacctctccgacccacccatgatttagctaacatctgatttggtcaaccaagcaccctggtcctcaggttcagtgtgagacttaatgaaataggcgtgaatttttttttttttttttttttagacggagtctcgctctgttgcccagcctcgcaatctcaactcacttcaacctctgcctctggggttcaagcgattctcccacctcagcctcctgagtagctgagatcacaggcgcccgccaccacgcccggctaatttttgtatttttagtagagacggggtttcactatattggccaggccggtctggaactcctgaccttaggtgatccacccaaagtgcttggattacaggcatgagccaccgcgcctggctggcatgaattttttcttctgtccctagttcatcttcaggtcactgtctgattttattagttctcaaatttaaatcactatgcatgctcagctcttctagttatttcccttctttcctcatgttgggaaaaaaaccccgatttattctaattgtgagaaatgaaagcgaacaaatcctatcattccctattgtcttgtgcaaatatgaagagagatatgatagtggggtaaataaaagcatcagggaatccattcggcagaatctttctcctctcagcgtgcttgcagttagatattctgagattccagtggagaaatggtatggtggaaacattgaggttcaacaaggctcaatttagggcatattttattcagattctaccatatatattgtctaaaatgaaacaacactggggaatgaaaaggttggtcgaagatgcaagttgcctttattaaataaagacaaatatttaataaaaataatgtataaaaataatcacaattcactttcaaatctgaaaatactgagttttccaggctacacataaataaaactgccaacgatgacaattccagcaactaggaaaacaagtacgcctacaaagaaaagtgagaaaattcatggagaatttgaactcagaaccaactcctcggagctgatcttttttgggggaagccagggaacgcgccgggcgctctcatcagcaagaccatgtttaaagagagtgtggaagcacagaccaaaatggacattcgagggcgaacagcagctggcaaagggataagtgatccgaagcattaaagcccttgagacaaattccggcgcgaaccgccagtgggggatgagactcgcaggcgcagccctccaggccccggcggactgacacgcacgttggaaacggagtcacccaccacagccccgcagctccagccaaaatggcgccgccgctctgcccaccccgcgcaccccaggcggccgccgagcccgcgcgcgcgccctgtggagcgaggacgccggggacgcggccagggacgcgcgcgtcctcacggcggttgcacgcctgcgcgagggcgggcggcgggggcgcgcgcgcggcgggggcgggctttgccgagcgcagagctgcagccgccgagccggacgtgtccgcgaagatggcgggccgggtgagtgccggtctgggagcccaggcttgaggcaggggcgccgggctcgcgggcactctggggtccaggcggccccagaggagtgggagtgaatccgagcaatggggcgcgaggccagagcgggacttgagggtagcaggggagcggtggcaggggattagccctcctcaacaactccacccccctcgaggggagatgacccctcgttacacgcgtctgctgcgcctcccgtcatcctcccttcccatcccttggggcttgttccctcgtcctccacacagccgcagggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaaggtcgttgggaaagaggagggggtgccaatgacttttagtgttaaagcccggccatctgggggacctgtcaactgtcgggtcaggcaggaattggctttagcttggagtgaggatggatttggggtgtcacgttttgtttttatggatgacagtcgcttcgaatgcagcaggatatgctgtagtttcagggttttaaatttacttcctcctttagcctttaggatcgttgggtaggatgggtttggcgaggagagagagctggttgagtgctgtattgcagtctgccttgagctaaaagctctcaagggatgagtcctgcccggagattacactggtcataaacctgaggacattaactgcgtcattgggggcgaaagatgtgattgactgatctatttataacagaatttttgaataagtttgcatagatttatgcatatatgcaaatgccctatctgaagggacttgtaggtcatgagattctagagtaagaagggatcttaaaggtcatttagtttggcttctttctcttccttttccccatggcctctccttttaaggctagtccttctgccagtacttcagaccctatctgtatattcacctgctccttcttaacataatcaagcttctctatcttaaacccttcccccacccccacagctgtcaccttttcccgtcccagtttacagcaggaaatttgatagagttgtctatatttattgtcttccatttgcttaccacctactcacccttcaacctactgcagtctgatttctgccccatcatcccactgaaacctgtccctcaacttaattgatacctttcaatccttatcttatttgatatctcagcagcgtttgacgttgttgaccatggcttccttgacggaaagcactcttcacatgtgttctggaatgcctcgctcctggtttgactcagacctctcttttgcggcctcaccctcctctactttgttattcattgctggtattcctcaaaggccgtcttctcactctcaatttcccgctcaggcaatttcttctaagcccatagctacaactgtctatatgccagtgattctcaatattttacccccagtccagacctgccctttaagtttcaggttaatatgtccaactgcttatttaaaatcaaggtcccgaaacgcagctttttcaactccgaacccaggatcttagcccacctaacttgtgtagatactcctcgacttaacgatggggctaccttccgataaacccattgtaagctgaaagtatcagaagttgaaaatgcatttaatacacccgatctaccgaatatcatagcttagcctagcctgccttccttacacatgcacagaacacttacattagcctacagttgggcaaaatcatctaacataaacctatattataaaatgttgaatacctcatgtcatttattactgtgctgatagtgaaaaacagaatggttgtgtaggtcttcaaagtacagtttctgctgaatgcctatcacctttgcactattgtaaagttgaaaaatgttaagtcaaaccattgtaagtcagggaccatctgtacctatccagtgagataggaatatctcactgaatgataccatcatccacccagttatataggctgggaatctgagggagggagagggtgggtaaccctttatatctctcttttgctgtacccatgtcctctgccctatcccccggtaaaatttgtcagagttctgctcctgccccccataaaggtatttaattagggccaaagactctggtttgggggaatggttgctttagactagttccaagtcacccactggactatctggattggtcacatgggttctgtcattttaacctaaaaatctccagtctgtccacctttccacatcttcatttttacctccttttcccaaactaccatcatttctggtctggactactgcaggaagcttccaagtatttttttgttcgtttgtttgagatggagtttcgctcttgttacccaggctagagtgcaatggcgtgatccctgctcactgcaacttccgcctcctgggttcaagccattttcctgcctcagcctcctgagtacctgggattacaggcgcccaccaccacacccggctaatttttgtatttctagtagagacggggttttaccatgttggccaggctggtctcgaactcctgacctcaggtcatccacctgccttggcctcccaaagtgctgagattcgtgcccggcctcccaagtagtcttcttagagcatgtggcccacctccaattcattcttgaccttcattgttccttcccgtgcctattactacttaaacccctcctcagcagcatcccattacttttgggagaaaaccaaatccttaatgaggccttcaggactctttgtggttctgctcctgcttctttccactcattctcttactctgtgtgctcaggttatatggtaaacgagcctttcaattccttgaacctgtagtttctcttaccacaaggtctttgcgagtggtgtttcctttctttgtaacgttcttccccccaaccatttacctcctactcagacatcacttagctactcaagggaggcctactctgaccccacattataagtcaggatcctttgttatatactcttgaagaactgtattcctctccttagagatttatctttttgttactttgagtgtgtgttattatttgcttctaccacttcacctcagtgaaaagcagagaacatacaagttatttagtcattatcaactgcgctttgtgtaccttgtgggacttaggtactcaatacatttttgttgaaaatgaatcagtctctgaacactctggtgatagatggtatattaccctaaagcttgcctgtaatgtcatacagctatgttaggtctttgttatctggagttccatgtaacttttatacgtagttactatttctgctgtttcaagccatacggaactaaacacaattctttttccatgtaatagctactcaagctactcatttacttgaatacaggttacatatctcctcagattttcgattttgcaagttaaacatcccccaattcctagcatatttcatattccaaacccttcatcatttaggctaccttcctctggaagtaacctaatgttactgttttgtcaacctttcttctaaaatgtgcccagagtggaacacagtgatcagagaagaatgtacttaagctattattgtcttgagatggacactaccattattcataccagataaaattgtattagcgttttttctatagtaaatcacattcttggctcatactgagcttgtagtcagtgaaaactcatgttcttttaaaatcagctccctagctccattctaggtttagagcagttttattgaacctaaatcaagaccttatccttttacaattcatttttttaggtcagtgcatgtctgctgtttgttgaggtaatctggattcttagttctttcatgttaggaaacataatagctgtctcttccagtttggttagatctgtaggtttaatcatgacttctgtttctacgtttgagttattggtaaaggatagaataagacagggtcagaaataacccttggacatgctgccagtgacatgcctctagactgatacccattaatacacttgggcactgttgcttaaatacagatgtgtctcatttaattccaacaaaacaacctgcaaagtaggtagtattatctttgtttttttgcagagagaaagagagagagatttagtaacttgagaagttcacatagccagcaagaagcagggtcaagatttgaactcagatcagcctggtactgttacctagttcaccagcttagttgcaagagtgtagtaaagactaggtttacctcacctagaactttttggacataataatgttcagaaactatcttctaccttttggaaaatctgaaaaactttggcccatctgattgtctatcatttcttctgatagcctttattttctagtaactactgagtgatttttagcaaaaatagttcaccttgttgcaatacttttatttgtgcatatttatggagtacatgaaaatttttttacatgtgtataatgtgtagtgatcaagtcagggtacatgagtccaatgtattaagtatagtcatctactcagctatcaaacattgaatttattcctcctatcactggatcttttttttttttttttgagacggagtcttgctccgtcacccaggctggagtgcagtggtgttatcttggctcactgcaacctctgcctcccgggttcaagcgattctcccgcctcagcctcctgagtagctaggattacaggcatgtgccaccacgcccagctaatttttgtatttttagtagagacagggttttaccacattggtcaggatggtcttggactcctgacctggtgatccacccgccttggcctcccaaagtgctgagattacaagtatgagccaccgcgactgacctcattggatctttttaccttttaacccacttctcttcagcctttctctcccttactccgccttcccggtctctgttatctatttttccactccctgcctccttgtgttcaaattttgtagctcctacatatatgtgaaagcatgcaatatttgtctttttgtgcctggcttatttcacttaagagaataacctccagttccatccacattgctgcaaatgatatgatttcattctttttatggctgaatagtattccattgtgtacatgtatgacatcttctttatccattcatctgtagatggacacttaggtggttgattccatatttttgctattgtgatagtactgcaataaacatgcaagtgcagctatccctttgatacattgatttcttttcctttgtgtagatacccagtagtgggattgctggatggaaggtaattctatttttagctttgagaaatctccatacagtgttccttagtggttgtactagtttacattcccaccgacagtgtatgtgagagttcccttttctctgcatccttactaacatctgttactttttgtctttttaataatagccattctgactggggtaagatgatatctcattgtggttttgatgtgcatttctctgatagtggtgtggaacatttttccatgtcttcttttggccattgtatgtcttcttttttaatgggattatttgttattttccttttgagttgttcgagttccttgtatgttctggatatcagtcctctgcttgatgaatactttgcaaatattttctcccattcaacaggttgtctcttcattctgttgattattcttttgctgtgcagaagctttttagtttgcttaagtcccatttgtttagttttctttatgttacctgggcttttgatgtcttaatcataaattctttgcttacaccaatgtccaggagtgttttccctagactttcttgtagtatttttatagttttgggtcttaaaatcttcaatccattttgagttgatttttgtatatggtgagagataggggtctagtttcacacttctgcatgaagttatgcaattttcccagcatcatttattgaagacagtgtcctttccttagtgtgagttcttgtcagtgttgttgaagatcatttgtctataattatgtggttttatttctggattctctattctgttccattggtctacatgtctatttttataccaataccatgctgttttggttactatagctttataatatattttgaagtcagataatgtgatgtctgcagctttgttctttttgcccaggtttggtttggttgtttgggcttttttctttttccttttttggtcccatatgaatcacattggtattttgatagggatttcattgaatctgtagattgctttggcaatatggtcattttagtgatattaattctttccacaagcataggatgttttttgatttattttctttcattggtgttttgtagttttctttgtagagatctttcacctccttagttaaatgtattcctaggtttttgtttgttttcggtagctattgtaaatgggattgccttcttaatttctttcttggctagatccttattgatgtatagaaatgctactgatttaaaggttttctaaacctacagatatataatcagcaaagagacaatttgactttctcttgtccagtttggatgcctttcatttctttctcttgtctgattgttctggctaggatttccagtactgtggtgaataggagtggtgaaaatgggcatccctgcctcattccagcttttagaagaaagatctcacctctcctcattcagtatgatgttagctctgggtttgttgtgtatagactttattattttgagatatattccttctatgcctaatttgttgagagtttttttaatcatgaagggatgttgaattttatcaaatgtttttgttgttgttgcaatactgttttttttttttttttttttttttttttttgagacagagtcttgttctgttgcccaggctgtagtgcagtggcgcgatcttggctcactgcaacctccactcactgggttcaagcaattctcctgcctcagcatccctagtagctgggattacaggcctgtgctaccacacccagctaatttttctatttttagtagagacagggttttgctatgttggccaggctggtctcgaactcctgacctcaagtgatttgcctgccttggcctaccaaagtgctgggattacaggcgtgaggcactgagcccggctgttgcgatactcttaatgggttttatatttcctttttgtgggggacagtttattttgcattcttactacttttgatattctgacatcatcttataagtgggatttatattcactatgtaattgaagttttttccaatgaagcaccgtatatagtttatctgggaaattggctgaagaataaaatgtgtgatgttattcagtgtacagtttctaggtcatcagaagataccactaccttcccactactggaaaagaaaaaagaaaagttttccacagtgcctgaactgttttgtatgcttatcttttaaaattgccagaaatctcacttactggagattcagcagtccctttctgaaaatacacatactttagtgcaaataaagccagtggatctctttcttcataagtccttaaacctagtcgaggtcatctgtttggcagagataggagtaagataatgtgaaataggaaccaacgagagagaacttgcttaggagttgaaaggggtatggaaagatgttagaggtaaaatttgtcgaatctagtgttttgactagggcaggccagaatattcagtatcagtatcaatatcagaagcttttgtagcctttgtttagaaacctagtcatttataacattttgtgggtgaatgacatcattaccaaacaaactttcagatgaaactttggaactcaagctgtaaattgtggatagctcatgtgcagtactacaaatcaaaacaaatactataaagtgtttggtagtccatttcctgaatgaaagtttgtccaaagtatatcaactttctgcagtcttacatgcagtagttattagttttgtgtatcgctttagtggatatttttaaaagtatcttcaaatgcaatgaattttaggaaacaaaacaattctttaaagcatcattagatagcttcttctttctgaaacccagaggaatttatgtataggatgactctttttttcaagtagttaagttaaggtgcaaaagtataaggtaaagtatattatcttaccattgaaaattttggcagtggcagaagagcgaacccttacaaataccttcattgggcaatacactaagcacttgctgtaatgctttttaaaacatctatactctggctgtggtattttaagtgaaaatctctcagtgagatactctttcgtattttagtactgatatccttaatattgctctgagagctaccttatactgacttcagtttcctagtgatttaaactactaatttccaacttatttttttttatagtgaaaactaaatattccttttgtagatgtaaccatttctggaagccctaagtatttttgaatgagtataattcatgcacactttaagagatttcaagcatgacaagtacagtgaataacatatatccatgtgattaccactgaggtttaagaaatgttaacatatgatatctgcttcagatatttatctttttaaaaatagaacattacagctgggcatggtggctcacacttgtaatcccagcactttgggaggctgaggctggtggatcacctgaggtcgggagttcgagaccagcctggctgacatggagaaaccccgtctctactaaaaatacaaaattagccgggcgtggtggcacatgcctgtaatcccagctactcgagaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctccttttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgtgtgtctttaaaatgtatataatggttttatgctatatctttctttctgcaacctgcatttttcacttaaaataattttgaaatttagtcctgtggatatatagtgagccaattaattctgcttagctactctgtagtctgttttgtgaatataccacaatcatctactttcttattagaggacaatttaggcagttccaattttatttttcccggaatgtacattattttagtcgagtgccattgccacattagcgatattttggttagtgagggactgcagataggaaggtgatcccaaaagattataatgccatatatttactctacctttctatatttacatatgtttagttacacaattacccattatgttacagttgcttacagcatttggtgctgtaacatgctgtacaggtttgtagcctaggagcaataggctataccgtataggtttgtgtaagtacgctctatgatattcatataacgatgaaatcacctagtgacacatttctcagaatgtatccctattgttaagcaacacatgagtgtgtgtctccatgcatatatgtgtaagagttagcatgtgtgtccagaggtagaattgctgggcgataagtcatactcatctttacctagttatgccagtttatactgtcactagcagtatatgagtacctgttatttatatcctctccaacacttaatattgctgacattttaacttttacaatataataggtgtaaaactattgtttaaatttgcatgttgtcctcattactagtgagattaagcatttttcatattggtcattgggatttccccttctgtgaattacttttgtatatttgctcattttttctgttgggctgtgtatttttttagtgatttgtataatttttcgttttttggggggtagggtatgctttggattctaatcctttgttgtaaatagcttctctcagacagtgatggtcttttcatgatgtttatagagtgttggatttaaattttatagttataattaccctttttttttttttaccttggtgatttgtgcttttatgtgtttttcaggaaatctttctccaccctgaagtcattttcttataaaagttttaaaattttgccttgcacattttggtgattgatcaggaatttatttttgtgtttggtgtgaattatgaactaattttatcttttccatatgtataaccagttgtctcaatatcatttattgagtccatttttttcctttactgatttgcaatgctatctctgtattatatccagttcccatatacgtgtgggtctaagtgtcgactctattccgtttcataattctttttgtccatatttgcatcaataacactgttttaattgctgtagctttaaaattattcttgttatttcatagggcgtactttcattacctttcttaatttggcatttcttggctcttttccgtatgaattctgggaacaacttaatccccactcctttaaaaaaaaaaaaaaagacactttggcctggcatggtggctcacacgtgtaatcctagcactttgggaggctgaggcgggtggatcacttgaagccaggagttcaaggccagcctggacaacatggcaaaaccctgtctctaccaaaaattagcgggcatggtggcacacgcctgtaattccagctacttgggaggctgaggcatgagaatcagcttgaacccaagaggtggaggttgcagtgagttgagatcgtgccactgcactccagcctgggcaacagaacgagacagttttttgtttgtttgttttaaagacacttttaaccttccgctatggatttttgacctacatttttcctcttgtattttataagagtagacacagagagcacttcaataaaattcagctcaataactttattaacctgatctccttttctttgactttaagctgaaagtgttaatttctcacaacttgtgctctatagatttgaaaccaaatcaattagcatcagctgtttatgagtaatgcagggtattttggtcttttgctaaattcagaaagaaatgttaaagtgctgatggatttgcactagctgtatagatctttggtggaggaggaaatgggaaaattattaatttcaggtaagaagtcatttttgaaatgcaagattcatttctttttaaaatcaccacataataaaaactttaagggctgcattggtgggtttttaaaaaaaattgtgaagtgtttttagtgttatgtgctgacaaatatttttgtagttgctttgacaagcaatgaaactaccaattatcactaattctgagtcttccaatgaacctctgtgtcaaatttttaaatttaattatcctatttttctcctagagaataatattgatataattttgtgaaccatagcagacagttcccattgctgagaatagagcctggtgtggggatattatgattcttgaatggttgaacaagacatttgcttctgaacatcttagtaaattatcacttctgacaatgtctgtagtttgaattttgatattctctgccaaggtattgaatactctaaataatgttgtttattctattatttaaatcattagtattatagatctagctttaaacagctgctgcactccagtcctttttcttcacctgcagatattgagtctgataactgttttgtatacatagcctttcagtaaatctacttatcagtcatcaaattaacttaattataagttaaatgatgagatggaccaagagtgttattgaaatctcatttccacacatttcttctcttcttttgtagaaggtaatgaaatgaacctgtcagtgttcctgtttttatgaagtttatttctcttagtacagtgattctgatagtgggttctgcagaccagcaaattagcattatctgagaacttgttagaaaagcaaattctcagttcccacttcaggctgactaatttagaaaccctggggtagggcttagcattctctttcaataaattctccaggtgattctgatgtatgttaaagttgagaagcattcacttagtgttttgagctctccaatttagttccttataaattgttgaagatattttttccagatttctttccaaatatgtgctcaaccttgttactgataggtttcaaggttatcgtcttcttcccattaataccttcatctatatccaattttcaaacttttaagaaagcatggctattttgctgcagtatggtgaattaggtactctgactgaccttcccagataaacaatttaaaattctagataatttttttttggagggaggacagggtcttgctccgtcacacaggccggagtgcagtagtgtgaacatggctgactgcaacctcgacctgttgggctcaagcgatcctcccacctcaacctcccgagtagctggggccacaggtgcacaccaccatgtccagcaaatttttttattttttgtgcagatggggtcttgccttgttgcacagactggtctcgaactcctgggctcaagcagtttttccacctgggcctctcgaagtgctgggattacaggtgtgagtgactgtgcctggcagatgaaatattttttaagtaaaaaccttatgtgcatggagatagctggctgaaaagtaaggaataatcaggccaaaaactatgtgaaggtgaaaacccagagatataagccaagtactgctgccttgaggacattatttgcaaatgacattacttggaaaacctagttaacttgtgcttgtgcctcaagaagctcagagaacggaagataaaagtagttttctggtagaacgtcccacctctcctggtaaagatggtaccccaagggtctatacatcataataaatgagaactagtaataaacgtaccttgtctaaggatcggaaagaaaaatttcctgcctcaaactttggtggtgatgggaagggtacagaaattccctgagaagttttacccacaagctgaccttcatgcaggtttgaatcctgattttatattacctggatggtatgaaaatcttaagccagtaattaaatataaaagtggtacaagagtgacgatgccttaaaatgcctaagaatgcctaaaaagcagcaaatacaaagcttcttgggagaacccatcttgatcttaggatttagaaaattcctaaacataaagctgtaagaaatatgaactcacattcacaaaatgcagaaagaaataagatgcaatgaatgagaggaagcagaaacaataaagagcagaatcagaacctgcaaagagttcacatattggagttagcagacacagattataagtacatatatttaatatgcttatagaaaaaaagaaatttaaaataggaatgaggagcaagtatacaaaaatgaccagtgtacaaatttaataacagattagacacagctaaagaaagatttagtaaagtggatctgaaaaaattgcagtatagaggcaagaaaatgaaaagtaataaaagagttaagagaatacagagggtagaataagaaggttcagtctagtcagaattctggggcaggggagcaggggcatggaaaagaatgaggcagaggcagtatttgaagagataatgacagagaactgatgaaaaacaacctacaaatttaggaagctaaagaatcccagaaaggataaaaagaaaaaaaattcacacataaacattttttaaagaaactacatgataccatagagaggtcttaaaagctgtcagaggctgggcatggtggctcacgcctgtaatcccagcactttgggagcccgaggagggtggatcacctgaggtcaggagttcaagaccagcctcaacgtggagaaaccctgtctctactgaaaatacaaaattagccgggcgtggtggtgcatgcctgtaatcccagctactcaggaggctgaggcaggagaattgcttgaacctgggaggtggaggttgcagtgagccgagatcgtgccattgcatgccagcctgggcaacaagagcaaaactccatctcaaaaaaaaaaaaaaagctgtcagagaaaaaagatattaccttcaacaagtatttggctgtcagctgttttcctgtctataataatgaaagccataagacagggagtaatattttccatatgcttagagaaaataattgtcaaccaagaattgtatatcttgtgaagaatgggggcaaaattagacactttaaaacagacaaacactcaatgttgtaaccatcaaaccttccctactagtggaaattcagatcaatttcctgaaggctaaaaaaaaaaaaaaaaagtgaccactgatgtaaagtctgagatttaagaaggattgaagagtaaagaataatggtaaatctgtggatatattgaaataaatattggctttataaaatgatgtatgcggaggttttaaaaatagaactaaataggccaggtgtggtggctcacgcctgtaatcccagcactttgggaggctgaggtgggcggatcacctgaggttatgagttggagatcagcctgaccaacatggagaaacctcgtctctactaaaaaaaaaaaaaaaaaaaaaaaaaaattagccgggtgtggtggcgcatgcctgtaatcccagctactcaggaggctgaggtaggagaattgcttgaacctgggaggcagaggttgcagtgagccgaaatcacgccattgcactccagcctgggcaacaagagcaaaactccgtctcaaaaaaaaaaaaaagaactaaatatatgataacaacatccaaatcaaaagagtggttaaagtattttatgatctttatactgttgaagagaaaggtaaagctattcaattaactttagattttgataggtatgtgtattagtattttcagagtaactactaaaataatataaatattaggaataatttatagcagaaaaaacaatttttaaaaggcaaggaagaagtgaaaaacatagaaaaggtcagataaagaggaaacaataaaatatagaaatcaaatcaaatatatggtagactaaatgcttcattcagacaaagaatgtcagattggattatttaaaagcaagcaggccgggtgcagtggctcacgcctgtaatccgagcactttgagaggctgagacgggtggatcacttgagatcaggagttcgagaccaccctggccaacacggccagctggccatggccagctaatacaaaaattagctgggtgtggtggtgcacacctgtaatcccaggtacttgggaaggtgaggcaggagaatcacttgaacccaggaggcggagattgccgtaagccaagatcatgccaccgtactccagcctgggcaacagggtgagactctgtttcaaaaataaataaataaataaataaaagcaagcaaacaaacttactgaaacaacacaaaatccagctataattttcaagagagatagctaatacatatgaatgtagaaagatagaaagcaaaaggatggaaaaagtctatcaggcaaactctaaccaaaagggaggtaaactaactatattagcatcagacaatatgatctttcagacaaaagagacagctagagataggtccctcaacaatgagaaaaggtttatttatccataaaggtaaaaacaattccaaacttgtgtgaacctaataattgcctcaatatacaaagaacaaaatgacacaattataagatgaaatagacaaatctaccatggtgaggagtttcaaaactccctaattgaaaaattaaaaagacaaaatggttacagctgaaaattaaaattaaaaattcattttctcggttgcaatagccatttttcaagggcttactagtgacatgtgacaatggctgctgtattggacagcacagaaagtacttttgcactgcattaatttagaagacttaatataattaacaatattaataattgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaaaaaagtgattaattggatttcatcaaaagacactgacttagtttgcttaggctgccataacacaatactatagacttggtggcttaaacaaaagaaatgtattttctcacggttctggaagctggaagtttgggaccggggtgccagtatgactgcgttttggtgagcactgtcttcgtgacttgcacacaggcttcttgccacgtgtctgtgtggcggagagacagcaagatctcaccatctctcttccttttcttataaggccacagtcttgtcagattagggcccttcgcttatgacctaatttagcctcaattatctcccaaagtccctatctccaaaatagttggggtgggggaagcgccttgactaatgaattttgttgggggcagtggggagtgcacatttcactccatagtagacaccattgaggagaaagaccagagtggaagaaggtatttgaaatacatgtatttgacagccaggcacggtggcccacacctgtaatcccagcactttgggaggccgagccgggcggatcacgaggtcaggagatcgagaccatcctggctaacacagtgaaaccccgtctctactaaaaatacaaaaaattagccaggcgtggtggcgggtgcctgtagtcctagctacttgggaggctgaggcaggagaatggtgtgaacccaggaggcggagcttgcagtgagccgagattgcgtcactgcactccagcctgggcgacagagcaagactctgtctcaaaaaaagaaaagaaaaaaagaaatacatgtatttgacaaggacttgtacctggaatatataaagaactacaaatcaagaataaaaagaaaggacagaaagccaatggaaaaatgaacaaaggattcaaacagggatttcacaaagaacttacctgtaacgtatgttaaatgctcaacctcattagtcatcagagaaatacaagttaaaacctcagggagatattactacacacccaccagaaagttaaattaagaacacatttgtcatgacaattctgggtttgattttgttttgttttttgagatggagtcttgctcttgtcgcccaggctggagtgcagtggcataatcccagcttgttgcaacctctgcctcctgggttcaagtgattctcctgcctcatcctcccgagtagctgggattatgggcacccaccaccacgcctggctaatttttgtattttagtagagatggggttttgccatgttggccaggctagtcttgaactcctgatctcaagcgatccacctgccttggcctcccaaagtgctgggattacaggcatgagcccgcgcacctggcctgtcatgacaattctaagtggtgatgaggatgtgcagcagctggaactgatgaaaatgcatgagcacaacctctttggaaaactagcagaattccctaaaactgaatgtaggcatgatgcccatgacccagcacttatagtcctgggggtgggaggagtgaatatatttctattcatgatttctatctctgatgacagaaattaagctagtgggtatctgtggttgagtagaaggatagtgactaggagcgggcagtatgggatgctggtaatgtcctcttgacctaactgttggttaccctgggtgtgttcacttgtagaaattcattgagccaaacacgtacaatgtatgcatttttgtgtatatatgttcttcttcaataaaaacttgatttaaataatgttctttttcttaaactgggtagtaggtttatggtgttttatgtgttgcctgtgttttatacatattttattcctgttcagtgtccaaaaaatataaaaagtagtcactgctttgttgttaatttgagcatctcctgcacctagcacagtgcctgggacattatagatatttattaaatatttgttctatggaaaagaagtaggctagtaatttctttttgctttccaacagccagtttttgattcaattatttgtaaatatgatttctactcagttgtttctaaataataaaatatgtaaatactattatgtttatatttattagtaagctgaatttattaaatgagaaacctctcaatattaaggacacatcataaattattagcatgctgtgttataatgactaaaagtagtatcaacaatttagataagtatagtgtggccttacggatgtaagtccgtaagatcatgcagcattgaagatgtgcagtttactagatcttctaatattctcgggtgtctcactgtttcttttttcttttttttttttttttgagatagggtatcactttgtcacccagtctggaatgcagtggcgtgatcagggctcactgtagccttgacctcctgggctcaaacctctcaccttagccccctgaataacggggattactgatttgtgccaccaagccaggctaatttattttctttctttctctctttctttctttctttctctctctctctctttctttctctctttctttctttctttctttctttctttctttctttctttctttctttctttctttcctttctttctttccttctttctttcttttctctctttctctctctctctctctctctcttcctttcttcctttctttttgtagagtttgggtctcactatattgcccaggctggtcttgaactcctggcctcaaatgattctccctccttggcctcccaaagtgttgagattatagttttcagccaccgcacccagcctcactgttttcttcagttgtttctgaacaactggaatctcagctgtctttttccattaaatcccgtgttcgttcctccataccatgctgcctcttgcccatttttgcatttctcctttctgctttcctgaacattctgagtcttactgggctggcattcccttgttgggacaggggagaggctctaggccttggatccttgttctgattccttctccaaagagttttccctttttcttcccctttcaaaacaacataagtgcaaaagctttgtcaggatgttgggaattaaaaaagcttcagaaacattttgattcatttaacaacattactctgaaactttttagagtaagagtaccaagtcactgaataagacgatcttgaaattaaacgatattttacagttttaaaaacaccttcacagatcttttcttattagattctcagcacaaccttatgagttggcactgtcaaaattcagttcaacaaacaaaatccaactaacaggaaaactcacagctaacatcatacttaatggttgaagactgaaagctttcccccttaagatcagaacaagacaaggatgctcttgccactcctattcaacactctattggtggttctaggtggggcagttaagcaggaaaaagaaaatacatttatatcagaaagaaataaaactatatttaccgatgacatgatcttacatgtagaaaaatcctacagaatttaccaaaaaaaattggaactaataaatgagttcagcaaagttgcaggatacaagattattatctaaaaatcagttgcattcctatatgctagctatggataatctgaaaatgaaatagaaaaaattccatttataataacatcagaaagaataaaatacttatgaataaagttaaccaaagaagtacactaaaaagtacactaaaaaacagaaaacatgttgaaggaaattagagatctaaataaattgaaagacgtcctgtgttcatggcttggaagacttaatattgttaagatgacagtgctacccagatttatctacaggtttaatgcaatcactatcacagttcaactgcctttttcccggaaatggacaacctgatcttataattcatatggaattgcagagccatatttgccacaacagtcttgaaaaaaagagaacaaaattgtaggactcatacttcctgatttcaaaacttattacaaaactacagtaatccagatggcatgtcactggcatgaggagagtcttgtaaaccaatggaatgcaatttagagtccagaaataaacccatacatttatggtcagttgattttgaccagggcgccaagatcattaactggggaaagaataatcttttcaacaaatgttgctggggcaactggatatctacatgtaaaaaaataaatttggatccctgcctcacatcacatatgaaaattaactcagaatggatcaaagacctaaacctgttaagttcttcgaaggaaacataggtgaaaatctgtatgaccttggattaaatggtgatttttaaagatataacacaaaaacacaagcagtgaaagaaaaaggtagataaactggactttgttaaagttaaaaactttcatgcatcaaaggacactgtagaatgaagacaactcacagaatgggggaaaatatttgcaaattatatctctgataagtatatatattttatatatatgttgtttatatccagaatatgcaaagaaccctttcaactcaacaaagataagacaatggaatttaaaaatgggcaaagcatttgaatagaatagacatttctccaaagaagatgtacaaatgacctataagcacatgacaagatcttcaacatcatagtccatagggaattacaaatcaaaaccacaatgagagataacactttacaccctctaggatggtcatacttttttttttttttttttaaagacagtaacaagttttgataaggaagtagagaaattggagccctcattgctgatgggaatgtaaaatgatgcagctactgcacaaaagttttgcagttccttaaaaaactaaacatagaataactcagcaattctactcctgggtatagacccaagataattgaaaacatatgttcatacattaacttgtacatacattaacatgtggcattattcatagttgccaaaaagtggaagcaacccaaatgtccatcagctgatgaaatgataaatacaatgtggtatatccatacaatgaaatcttatccagctgtaaaaaggaatgaagaagccaggtgcagtagctcacaactgtaatcccattgctttaggaggccacgatgggaggattgcttaaggccaggagttcaagattggcctgggcaacatagacccagtctctacaaaataaataaataaaaagaatgaaatactattacgtgccacaacatgaaccttggaaacattatgctaggtgaaaatccagtcaccaagatgacgaattgtatgattctgcttacgtgaaatgtccacaataagcaaattcatagagacagaaagtagattagtggttgagaaggagtgagagaagggatgaattgagattaacggctagtagggacagagtttctttttggggtgatgggactgttctggaattagatagtgattatggttgtacaacatagtaaatatactaaaaaccactcaaaggctgggtgcagtggctcatgcctataaccccaacactttgggagactgaggcgggaagattgcttgaggccaagaggtcaagaccagcctgggcaacacagcaagaccttgtttctacaaaaaaaaaaaaaaattgttttaattacctgggtatggtggtgtgtgcctgtagtcccagctactttggaggctgaggtgggaagatcacttgagcctgtgaatttgaggttacagtgagctgtgattgtgccactgtgatccagcctgagtgatagagcatgaccctgtctctcaaaacaaaaccctccaaaaaacaaaaaccacccaagtatacattttaaatgattaattttatgtgaaatatatcagctgggcgtggtggttcacacctgtaatcccagcattttgggaggcagaggtgggcggatcacgaggtcaggagatggagaccatcctggctaacatggtgaaaccccgtctctactaaaaatacaaaaaattagccaggcatggtggcacatgcctgtagtcccaactactcaggaggctgaggcaggagaattgcttgaacccgggaggcagaggttaaagcaagccgagatcatgccactgcactccagcctgggcgacagaacgagactctgtctttaaaaaaaaaaaaaaaaaaaatctcaaaaacggcaatgagaactcaattaatatttatcatactgtatattccctgagtggtgcaggagaatcagagcttagaatcttgtgaggaaggcatggtacttaaataagtctagtgtaaggcagcttgtaataagtagtactaagactgctgaagaagcacaaataaaggagatattctatcttactaggaaccagggagtttcacaaacttggctttgcaaggtgggaaagattttcacaggtggaaggggtttgaaatagggaattcagtcaaaaggaatagtgtgagtgaaggaatggagtttggaatgtggggtacatggggttggggtggggtattgaggtagatgacgcagaaaaataagttaaagatagatcttgcataggtggctgtgagtagcatgctaaggagtttgggctttattacttatgaatcatatttttggtttcaggtcatgtctggtggcagagggaaggctgaattggaggagaacaaaagctagaaccagggacaacaattattaccattgtagttttttaggagaggtgatatggctgaactaggttatggttgtgaggctggaagggaggcacatccacgtgacagtgcagtagacttagtagactcttgattgtttatgtgtgcattccagggataggcagtgaagggaagaatgaccctgaaatcttgaatttaatgacttgaaaggataatgatggtattaacagatgaggaacatagcaagacaaacaaatgaaaaagtgaatactgaggagaaggaggtaccactgaatttggcatttagtcattggtgattttgaagacagcagttacagtaaagtggctgctggaaaggatttcaaagaatggttgaagaagatagccataggatgagaacatggaaggcaaggaagggagacttgagagatttggtaataaagagaagagagaaaagggtgctagtttgaaatgagttaaaagaactacagagtagaattaaaataaagtagaattatgggatttttgctttttaagtgacccatgagaggcttactggcagtgtgccaagattcaagagagcaaagattggcagggtgggattaagtgatgggatagccgggtgcagtggctcatgccggtaatcccagcactttgggaggctgaggtgggtggatcacttgaggtcaggaattcgagatcagcctggccaacatggtgaaacctgtctctacaaaaaatacaaaaattagccgggtgtggtggtggttgcctgtaatcccagctatttgggaggctgaggcaggagaattgtttgaacctgggaggtggaggttgcagtgagccaagatcgagccactgcactaactccagcatgggtgacagagtgagactccatctcaaaaaagagaaaacaaaaaacaaaaaaaaacgacggtagggagccttctgcctctttaaacatttgagatgcatgtcctgagatgcttctgtgaagttaagaatattaattttttgatacgaatctgacaaaactagacatcaaaatatgccatatatggtaattaaaacaatgtggtattagtatagaaagcagacaaatagttaatgaagtagaacaaccaacccagaaatagaaccagatacacctgaaaacttcatatatgaggtttaaaatcagtgtggaaagctggaaatcacccatagtttcgttatccagtcagttgtttttcacattttggtgtgtttccatttagttggtttgccatacttttttaaaaataatgctttaaggctgagcgtggtggctcacacttgtagtctgaagcaggcagatcacttgaggtcaggagttcgagaccagcctggccaatctgatgaaaccccatctctacaaaaaatacaaaaattagcctggtgtggtggtgcttgcctgtagcctcagctacttgggagactgaggtgggaagatggcttgagccagggaagcaaaggttgcagtgtgctgagatggcgccactgcactccagcctgggtgataaagccagaccttgcctcacaaaaaaaaaaaaaatgctgtaaagtaaaagttctgtatacaattctgtgatatgaaccctaccttagtgtgttatgaggattttgatccttatatgatatgatatatataatcaagtgcgggtacgttgtagtttacagaaccattactttgaaacaagacctttaggttactcctaattcatcactgttaaaataatgctgtagggaaaaaattacacataaaagttttctatatttaaaatgatttttgtgagacaaagtttatttattgtaaaaacagttccagcagttcagaattgtaaagagttttacagaattgtaaagagttcagaattgtaaagacattttcttgtctttctccttggtggtaaccactgttaacagtttagtgtgtatcttttttttaagtttagtttttatttttttgtagagacagggtcttgctttgttgcccaggctggggtgcagtggtgtgatcatagctcactgcagcctcatactcctgggctcaagcagtcctcccacctcagcctcccaagtagttgggactaccggcatgtaccaccacgcctggctaatttctgtatcttttgtagagacagggtttcaccatgttgcccaggctggtctggaactcctgggctcaggcgatccccctgcctcggcctcccaaagtgttgggattacaggcatgagccactgcacctggactagtttctttttaatttctgagtagtagtcaattgtatggctctcctataatttcttcattcattcatcttttggtagacatttgtgttgtttccatttttaggctattatgagtacagctgttgtgatcatttgtgtgcgagtctttgtgtggatatattttcatttcttttgactaaaaacctaggggtgcacttgttgggtcacattaactttgtagaaactgcattgcatctttgccgatattgaaagttgtcagcattttatatttttctgtgcatgcttttccccccaaaagaccaaaatgggaattgtttttcttttcattataaacttgtaaaggaattttaaagttctaagggatgccaggcaggaggttcatctatgtgaacagttattagtttgagatagataatgtcaaggatatccctaaaggcttttcaagagataactataggacatctaccccatcacttctagtcacatgtgacttcagaattttaacagaaattattattataggaatatgtagcacagagggattccataggcctgaagattagtactgatggcctttcttacattattctaggctggtgctatccgatgaaactttctgcagtgataaccactagccacaggtggcttttgaaacgtagggctagttcaactgaagaattgaatttaactttaaattaatttgaatagtgaaatatgtctagtgattaccgaacagtgtagttctgaaatgttatttttcaggaaagatcctctagcaagaagtagttgagtgagacctgttagctgagctggccctggggcaggtttgtgttttcagtccttccctttcctgtgggagaaatgaaaccaaagcctagagcaccacagaagaagaaccagtggattcataagggtgacagttcaggtaggggaagctgtttggtaatgagctcttttggtcagatgccacactatttttctttctgtttattttgccctattaaattatttagtaaatagtaaagcgtactttaatccagtttttaaagtggacgtttggatgaaagtatgtgatttaaattccaaaactgtgcagtgttgtccagaagagtcctgattaaatcaccccagtttctttgatgaagataagcaaataattttattttttgctgtaatcccagctactcggaaggctgaggcaggagaatcgcttgtaccagtccggaggctgctgccctctcacagggcttcctcctcttgcacagacgcaccagtgccttcagccccactggtctccctcttctcctttcctggcccctgctggcccagtagatgggccactggaggccactagatggggactggggaatgtgatgttggcgatctgcggtatcttcagggtgacagccatacccaacgcgtgggacctggcttccacatctatagacctgacctaaggaaatatgtgggcgtgtgcataaggatgccatctcagaactgcatattaataaaaagctgaatcaaacagtgtccaacaagggtggctgttccagctggtcatctacaatctcagctcactgcaacctccgcctcctgggttcaagcaattctgccttagcctcccgagtagctgggactacaggcacacaccgccacacccggctaattttttgtattttagtagagatggggtttcaccatgttgcccatgctggtcttgaactcctgagctcaggcagtcctcccaccttggcctcccaaagtgctgagattataggcgtgagccaccgcacctagcctgtactttcatttcttaataactgcatgactgtagtggttggctttcattattgtttcctaggggcaaggtcaatgttagaaaaattgtggaattttcccttggcattgctgtggtgagtagacagctactatttatagagacttatacttcgttgaaaaaatgagataccatgcttggcttaccataaaaacacagatgtttctggattccagtagggaggccttttgttcacagcatctgttttggttggccagccagatgacttctgtggattttttcactccttttgaaggacacttgacaaataaacaagtttataaatgaaagagttaacagcattttgtaaatttattttattactttagctatatcgttctgtatattttgaactatcagatcattttagctcaattttatcacttcctaaataaccttgagacgatcagtcctttgttacatgttctttggattgtttattctgcagttgagacagatttttattgatctataaatttttgtgttcaacaaacatttaatgagtattcactgtgtactaggccctgtactaacactgggaactacatatgtgagcaagatatagtctcagtctttgagaagtttagtgtcttatatgcagtgcaaacatgtagacagaataaaattatagttgagtgcttccatttgaagtttatttcatcagtttagtggggaggggtaggtgtctaggaatgccttccagaaaaagtagtgtctaagtggagaattgtagaatgagtgggagttgtccagggatggaacaggggttagtggcggagattatataaaagaaagaagcttgcaggtgaaaatgaccctgggaaagtgggaaactgaaaaagttcagtacatttctgtcatatggctgatcaagctgtgactgggcaaaatgctgtcagcatttgttgaacacataaatgctgtctcattcacaaaggagacttgtgacctagactttattcatcttgtgctaaattagtgatttccaaacatttgatcatgaatctcataagtaaaaaatgttttgattatgtatcctcatatattgattatatgccaatatttgtttatagatgatatgtagtactaaaagttatatacgcagtagaacatgtatagaaaacaaaaaaaattaaaaggatgagctaaagatggcatgtacaatattctcacagtgttaattttactgaaaatacggaaagtaggctgggtgcagtggctcacgcctgtaatcccagcactttgggaggctgagggaggcagatcacttgaggtcaggagtttgagacaagcctgaccaatatagcgaaatcccatctctactaaaaaatacaaaaattagctgggcatggtggcacacgcccgtaatcccagctactcgggagggtaaggcaggagaattgcttgaacccgggaggcggaggttacaatgagccgagatcatgccactgtactccatcctgggcgacagagcaagactccatctaaaaaaaaaaaaaaaaaaaaaaaaacccagaaagtaaagtggtacatcattatttaaaatcttcgtttaatattatgtgatacagctgctcagagggctgtttctaaattcagtttattttgatactttaatggcagtcaaagcctggatcaaaatggaagaatttggctgcactttctaaatcatattctttctttctccaaacttattcactatttatggaaatgctttattgaaatgtggctggtaaatatccatctattagtttttcttgcagattaataaaaatatattatacttttattgtgttaataaatgggttccaaaaatcactgttaagtcttcatttggaagatattttaaaaagttttagaatattctgtttctgactttataaagcatgaagatacgagtttttggtgtctttattttttagattttgtatatattgtttcaacagcagaataacttagcaatggaaatgtttccaattatccaattttgaaatgctctattaggaaagatttttttttctctcgctctcttttttttttttttttttttttttttaaagatgaagcctctctcttgtccccaaggctggagtacaatggtgccatcttggctcactgtaacctccgcctactgggttcaagcgattctcctgcctcagcctcccgagtagctgggattacaggtgcccgccaccacgcccggctaatttttgtattttaagtagagatggggtttcaccatgttggccaggctagtctcaaactcctgaccttaggtgatccgcctgcctcattctcccagagtgctgggattacaggcgtgagccactgcacccggccgatttttttctctttttcttttttctggaaaagctgaaaataattctgacatgttgctaaacatttttattttgtaggggcagagtgagtttttttgtttttttaatatcttcttggtagcatactacttataacctcctcagaaatatttagcaagtttggaactctagtctttttattttaaaaaaattgtgtaactcatctacatttaacaaatcttttaaatacatttcttgtggtaactagtgaatctgtgtggatttaaaaacaaaaaaaagattatgaggccaaggcaggtggatcacttgaggccaggagtttgagaccagcctggccaacatggtgaaaccccatctctactaaaaatacaaaaattagtcagaagtggtggtacacaactgtagtcccagctactctgagctgagaatgcgccactgcattcaattctgggcgacagagcaagactatctctcaaaaaaaaaaaaaaaaaaaaaaattcagtggctactctctatctcccagagtataggaagattctatattcatacagttaacctcagtgacatctgaggtaccttgttctgacttaattgcagcaatagtttacctgtgaatgaagctgttaaaggcttttgtatcagatgctatcactgtaactttgttctggaattttttttttttttgagatagggtctcgctctgttgcccagactggagtacagtgacacgatctcagctcactgcaagctccgcctcccgggctcacgcctttctcctgcctcagcctcccaagtagctgggactacaggtgcccgccacaacgcctggctaattttttgttattttttagtagagacggggcttcaccgtgttagctagcatggtctcgatctcctgacctcatgatccacccacctcggcctcccaaagtgctgggattacaggtgtgagccaccgcagctggccagaattcttttttaaaattccagtcaaagcagtcatttcatcagtggttacagttttcccataaagcaccttgtttcatttacagttaagaatacctcccttttaatacattgttccttggtatcttacaaagttgtatttcctgtatatttcataattacccagcaaataccctaagatgaaagaatcatctgtatttttatccaattgtatagcaaaccccacacactgtatttgtcctgatatcttcaagtctttagggttttctaagagcttttgactatacttaccaataaaagaatacatttagtttgtcaccacttttatttctgtgtataatttcagctatggtccttggctttttttagggaaaccttagcagtttcgacactaactttcgtacaattttgtgaagtgtcacattaaatagcctgtgactttagacataggtggaaaaattatagacgtttaactcttgcagtgaacacttaaaagcctggtggattatgaggactttgttcgtgccatcagattatatcttaaggtagagtagacatgtagagtgaggttcatctttaataaaaaatgggctgggtgcagtggctcacacctgtaatctcagcactttgggagaccgaggtgggtggatcacaaggtcaggagatcgagaccatcctggctaacacggtgaaaccctgtctctgatgaaaatacaaaaaaattagccaggcgtggtggtgggtacctgtagtcccagctacttgggaggctgaggcaggagaatagcgtgaacccgggaggcggagcttgcagtaagccgatatcgcaccagggcagtccagcctgggtgacagagtgagactctgtctcaaacaaattaaaataaataaataaataaataaataaataaatggtgtggctggacgcagtggctcacgcctgtaatcctagcactttgggaggccgaggcgggcggattgcctgagctcaggagttcgagaccagcctgggcaacgtgatgaaacccccgactctaccaaaaattcaaaaattagctggagcatgcctgtaacccagctacttgggatgctgaggcatgagaatcgcttgaaccagggaggcagagattgcagtgagctgagatccaccattgcactccagcctgggcaacagagagagactgtgtcaaaaaacaaaacaacacataaataagaaattgtgtgaagtcaatataaataccagtactaatattttatttttataccccaaaggattatcgtataatacaaacacccttcaagtacacatatcccactttggagactaatgccctaaacaacagggataatgatattgaaactggccttttagttaaaataaaagcaaagccaaaaataattcactttcctctataaatttatatttgggagacacatttaagaataatcgtcctggccaggtgcagtggttcatgcctgtaatcccagcactttgggaggccaaggtgggcggatcgtgaggtcaggagatcaagaccatcctggctaacacggtgaaaccctgactctactaaaaatacaaaaaattagctgggtatggtggcgggcacctgtagtcccagctactcaggaggctgaggcaggagaatgacatgaacccgggaggcggagcttgcagtgagccgagatcacgccactgcactccagcctgggtgacagagtgagactccatctcaaaaaaaaaaaaaaaaaaaaaatcagctttggcttgaggtttgaagaatgaacccttcagtcatagactatgactacctgtcatagctcactaggaaaccctagggaatcatggaagggttattggttaaatatattatataaaggaacattttgctagttgctattgaccaaaaaggctgtttttttttttttaaatatagtctgtaattatttttgttgaaagatatttggaagatggtttttctcaatctataggagatacagttcgtagccacctgggatctcttataaaaagatactttttcatagtatactctttataatatgcataacatttcataatatacttttgataatatacataaaatttgatacataagtttaccaaatttattgaatttacttcagtgcatttttattagtcaagattctttggaagatatggaaagctaattcaaaaaagcttgagcaaaaaaaatttgttggctcgtaactaatgttcaggactggtctcaagaacttggttgccagatctgtgtttccaggttatctattagcttgtctgtgtctctgtgatagttttacccttttagagtggaaaatcttcctccttgtggtgctctggcttgcagaagaatgcctttggtctagcgccagcatatataaaatcctgtgggtgggatagagtagatgtggttgcatgtgtgctgactggcagtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagtgagtatctgactttgttttcttttaacctgctaagtggcattcgggaaacttccagagagtcatttttaggaaacgttggaaaatatttttaaaaaattcttgctgagttggaaaatggagaagatgagaaaaagttatgtatttgaatcattactgtgtcaaactttgataaatactgtataatgttttaaaaatgttttatgtataaaactctagttttcatcagttttcttagtagagctaaacatactggttgtatgaatcatatatggcagagttgttaggtgtttggttctggcaaactcagattgtttgagttttcctggctctaccaattacaaactgtgtgaccatttctgtacctctatgtcctgatctgtaaaatggagatgatctcttcctcaaggtagctatgaagattgagttacataaataaagcacttagaacagttcccaacatgttaacaatcccttagtaaatattagctgttatgattattattaccatgataatccaagagacatgaacattggaagatgggctgggtatggaggcttacgcctgtaatcctagtactttgggatgccaaggcaggctgattgcctaagctcaggaatttgggaccaacctggccaacatggtgaaaccccatctctactaaaaataaaaattagccaggcatggtggtgtgcgcctgtagtcccagtttctcaggagactgaggcatgagaatcacttgaacccaggaggcagagactgtagtgagccgagatcgcgccactgcactccatcctgggtgacacagcgagactctgtctcaaaaaaaagtaaaggaaaaagaaaattggaagctgcaaagcaaatgtagaatccttaaaggcattttgcactgtaatttattttaactgatccatatcaccgcactgccaggacttctaaagaccctgctgcaagttcagtgccatccatatgcttctgagattggtacagataaggagatgaaggggctgtagggaaataagaggcaaggtggtagggttttaactgagcatttttcttaaaatgttatctgtgaaatacctgagtttcacagagttagaaatgctaatcatctttggtttccagcttcagagtaagaggctgtactatatggtgatattaacattgtttccagtgctaaacattctgtgatgctaaattgagcacaggattttcaacagataaactgaagtatagataatcaacgtgagaatttgtggaattcttttacatatgttaaatgttcactgtactcatggtggggttactcaaaatgtagttgatataaggaacatgtgttctagtggcaaaaaaaatacgtatagaaacattagccattgatgtgaaaaattacagcattctgaaaagataatgtttaaaaagatagtgagctaggcatgttagggcatgcctgtagtcccaactactttagagactgaagcaggagaatctcttgagcccaggagtttgaggccagcctggtcaacatagcaagaccacatgtattaaaaaaaaaaaaaaaaaaaaaaaaaaagatactgctgctgcataacaggatttgaagcttctatcttacacatagtactttttagttacctggtataggagattatcatgagaggactgttttttttttttttacaggtaatttctgaacagggaattagcacaaaattttttaaaacagtaaatattgatatctacatgaaagctgatgtattttgggaattttttaaatcttttttttttttattttgtaggttgtttttgttttagcctgttgagagagtctgcaaataaatttaatgagtagtctaaaaactaacttttttttgattgctatatcctagctcttttatctttggctctcttctccttattaggatgtgaagtaattctcaggagaggaaatgcatctagtttttacttgatatcaaggactctaaatcactggcttcagttttatgtaaactggaaatgtaaggaagttggtattttggatggtattttggctggattctacttgatgagtgtttgacccaaggtgctccttatatctggaaaacatttgggattgctgatagtttgggaaactaaatttgtggttctatttcttcaagacacagatagtgtcgtttccacctgatactcattaaatatcagtttgacaagaaatacattttgaaattatgttcttcatttccttcaatgtggagtactaactgtgtttctgtcctttaggcatgtgattgtgaggacctctcccaatcacaggtacacatttacactgaagacacatccatcggtggttccagggagcattgcattcagtttacctcaggtaactcagatgttaatttgttctcttctgtttttgaaagtcatagaatatgaataatctgttcattttaagcaagcatcaccctgtgactgtattgattcatattgaagaaaaatatctaagtattatataaggaatttaaagatacagtcttctttttttttttttcttttttttttttaagacagggtctcgttctgagacccaggctggagtgcagtggcacgatcatggctcctggtctcaagcaattctcatacctcagtctcccgagtagctgagactacagtcttgtaccactgtgcctgactaattttaaaattttttgtagagatggtgtcttaactgtgttgcccaagctggtctttaactcttgggctcaagtaatcctcccaccttggcctctcaaagtgctgggattatagggtgtgaatcatcatgcccaacctaaagacagattcttaattgccagtttttgctatggctgccttcttttggcttgattttttttccctaatttttaaagattttgcagtaaaatcagtcagctatcacataaagcgtcaagttattttaatgttaactgccagggtaatagaaaagtagaaaacattttatttgtgaagttgatatctaagaatggtgattttataatgtgatggcgttatactaaagaatttggaaagagtctcaaattacaacataatttgctaggctcccataacaactggatgggttgtgattacagttacaactgttgatggattctgtagaatccagagaattagattgcttagtgctgtcccaggcacatcatacataatataaagcaccaagaatactagtctgtatcctcttctcccttatcattttactcaggctgctgactgtccccagtcctaagtaatgtaaatggaattcctacctcctcctagtatgctaatgagcattggttgacttccctgaaggtttagagaaagagctcaaacactcatttaagaactattaggctgggtgcaatgactcatgctggtaatcccagcactttgggaggccaaagctggtggatcacttgagtccaggagttcaagaccagtgggcaacgtggcgaaaccccacctctactaaaaatataaaaattagctgagtgtggtggtgcatgcctgtagtcctaacttcttgaggggctgaggcaggaggatcacttgagcccgggaagttgaggctgcagtgaggcgagatagtgccactgtactctagcctaggtgacaaagtgagaccctgtttaaaaaagaaaaaaacaaaaacaaaaactattagatgggccaggtacctcacgcttgtaatcctagtgctttgggaggtggaggaggatcgcttgagaccaagaattccagatcagcatagcgagacccttgtcccccgcactagtctctacaaaaaaaaaattttttttaattagctgggcatggtggcacatgcctgtagtccaggctacctgggaggctgaggttgggaggatcacttgagcctaggaagtcgaggctgtagtgagctatgattgtgccaccatgctccagcctttgctccagagtgagattctgtctcttaaaaaaaagggaaaaaaaaggaactattgaagatctcttgaagccctcaaaaattacaggaaattttcacttactattccacctgtctgtttgatgcctcttcattatccagaccactttcacgtttgtttctatagattaaaagtttgggatattccagggttctccagcttttacagagttccatttgggattctgattgttagcaatagcttgaggtgtgacagtttctccttgtctctgttttgtaaaaaaaaaaaaaaaaatttccccgacattcactgtaggccagcctctattctaggtactttggcatgtgttagctcatttaattctccaaacaaccttatacaatagctactgttgttatccctaaggactgttgtattagtccattttcatactgctatgaagaaattctggagactggataatttataaggaaaaatgagatttcatggactcacagttccacatggctgcagaggcctcacaatcatggtggaaggcgaaggaggagcaaagtcatgtcttacatggcggcagacaagagagcgtgtgcaggggaactgccctttataaaaccatcagatcttctgagacttactcactatcatgaaaacagcatgggaaaacccacacccatgattcagttacctcccactgggtctctcccataacacatagggattatggaaactacaatttaagatgagatttgggtgggggcaaagccaaaccatatcagctgtctttgggattgaagtacagaacctaaatgtggcttccttgtgacttaaagtctaagcttaacgagcatggtgctaaatttcaggttggccagaagtgggatggggttttacagaagaggtcttctgggggaggtgaagggcagagtggagggaaacaggatgtggtaagaaagccacaagggagagcacttgttgcacatattcacagttcagtgtcttctaaattacccgccacaaagtctgcagtgtttggatgggcaggtgaactactgattttcaaccaaaaattgtttttctcattgttctttggagtgttaccagtaattactaattttgaatctataccaagcaaaccccagattcctgcctaaacacaatctggcctgccttcatacttcttgccattgtaaacagtagggatttgggaaagcctgaaatctagctgtaaatgtctaaaaatcttctggctagtatacaaagagtagccatgaccatctaatgatttcagtccctgactgggtttcaaaatagattttctgaccagttttaatttagtcttcatgaattgaatgtcttcctttttgagatactgtaacaaacagtaaaactaactgcagcagtacatttagaacactgaagtgtgatctgatacagtgaagaccttctgtagcatcatattgtgcaaaggaacatcctcctcagtggtgccagctttactgcaaaaggcaagctttgcacgttttgaaacagatgttcagatgtaaactgtagcacatgctttactttcctagggtaagtaacaaagaaccattactgggtagcttaaaacaacagagatttattctgtcaccgttgtggaggccggaagtctgaaatcaaggtgtcagtagagctattccctctctgaaggctctagggaagaacctgttctgtgcttagcttctggtgttgccggcaatcctttggtgttccttggctgtagctgcatcatttcaatttctgcctctgctatcacatgatggcattctgtctgtgtgtctatgtctctttcttagaaggacaccagtcatatcggcttagggttcaccctaattcattatgacctcatgttaacttgatacatttgcagagattgtatttctaaataaagtcacatccacaggtgttgggggctaagacttcaacatactttggagggggagagcacagttcaaccataatagcataccatgttttgatctttgagtgtattcctaaaattcattaaaattcctctttttctcttgtctaattttgatggctttggttttaagtatctttttttctcctttacagagaaaatgggctgggctttctattgggcaagaaatagaaggtaggtatattttttagccacctgataaagattttctatgtgattttctcacagttattgagatctgtacaattttctattactagtggtcagatcttaaacattcattgtatcagaagactggttacatctatgagaatgggaaggaaatagttatggtacctctgttcctatatcttttatgaagtgtgtgataaggtcgtcatagttcaaggcaaggaaagcaatttgtgacttccagttgggggcgtggcggggtggaaagactaagctgctaatagataataagccaaagaactaataagcaaaaagtggcattgtctcaggcaatgtggcaaagttaggaaatggagtatgagtcgtctttagtcagatgattttatgtcaacttcatggatacagtaggggaaggaaagaaaatgcaagtgtaattaaaccagcttttcttctgcttgtctttaaaacttaaaaaaaaattgtatttatagaaaggttgcaaaaataatacgaagaatttctgtatactgcctttacccagctttaccaattgtcatattttctttatcattctggctccctgtcttcctctctgggtctctgtctctctctgtacacacacacacacacacacacacacacacacacacacacacgcacacacacacacacacatcttttatcctactcctcatttaggaacctgacaacttgtaattttttctaagttagatggaatttaaacattggggttattttattttattttatttttgagatggagtctcgctctgttgccaggctggagtgcagtggcgcaatctcggctcactgcaacctctgcctccagggttcaagcgattctcctgcctcagccttgcaagtaactgggactacaagcacttgccaccacacccggctaatttttgtatttttagtagagatggggtttcaccatgttggccaggctggtctcgatctgttgacctcgtgatccacctgccttgacctcccagagtggtgggattacagatgtgagccaccacgcccagccaacattggtgttatttttagttagctttttctttgtggaagtatgaacacttgttaaatttaatgagaaagtggggtagtatgtagcttaggtttctaattttcataaattaatttttctaaatatgaggctaagagtacttaaaactttgaatctagatattttctattgtgacaagatacagaaattcaagattataaattttgatgagttgagaaatgtgttttgcggtttaagttataaaagcattcttctgctaacagaaatgcttatctggattgtaaagtcagatctttaaagaagtggctcaaacagacttaataagcaaaattgtaaaacccagtgataggtgggactaaagtggagtaagcttgagggaaggtagggttttggggcccaagtgatgtggatgatgtagccataaagatagaaaactggtttggtttaagtagtgatgtagaccaagataggataggaggtgtggtttgaaggagtgctcaagtattctggaatgggagttccgtaaggtgaaacattttagtcaaatcagtgattttagtctgagggaatcttctggaggaatcatttagtcggtcttctttccatctggcaatgccatattttaagtgttacaggctaatgttttgaccactatatatacacctattattgtaaagtccaagtttattcaaagaactggatacacttattttttgcttataaaatctttcttattagtcttttatattaaattactattagccgtaaaataagaaaacattctcaatcttctttgatccaggatgaaatcttcaggactcttgtccctttgggactgaccatggtgctgactgtggtgctgcctgggatactgtccatggtgctgcccatagcacttgaaattgtaacagtttggtcttttctatttaggaacattggccttaaattaaaatgcatttgaaaactacagtcagtgcattactgcagtcagtagtaattatatttttatttatttatttttgagatggaatctcgctctgtcgctgaggctggggtgcagtggcatgatctcagctccctgcaacctcctcctccccagttcaagcaattctgctgcctcagcctactgagtagctgggattagaggcatgtgccaccacatctggctaatttttgtatttttagtagagaaggggttttgccatgttggccaggctggtatcgaactcctgacctcaaatgatccacctacctcagccttccaaaatgctgggattacaggcatgagccaccacgcctggccaatattttaaatatacttattcaaatttctcagtatgaagatgacatgaatatatgtatatacacacatatatatgcattatgacattatgatattgttttggtgtctttaatgcacaaaatggtattatactgtacaaacctttctgcagtagacttttgtcactcaatattatgttttcaagggccatccacctttttttgagatggagttttgctcttgttgcccaggctggagtacagtggtgtgatcttggctcactacaacctctcctcccaggttcaagcaattctcctgcctcagccatctgagtagctgggattacaagcactcacccccacgctggctaatattttctatttttattagagatggggtttcaccatgttgaccaggctggtcttgaactcctgacctctggtgatccacccacctcagcctcccaaagtactgggattacaggtgtgagccaccacgcctggccaggccgtccatctttaataaatatacataaagttggtttttgtttttttgttttttttttgtttttttgacagggtctcacttggctggagtgcagtggtgcagtcgtggctcactgcagcctcagtacctggctaattttttaattttgtgtagagatagggtttcactgtgttgcccagtctggtctctaaatcttggacttaagtgatcttccctccttagcctcccaaagtgctgggattgcaggtgtgagccaccgtgcctggccaagttttaatttcaataaaaattgctgtaaagtattctacattatgaatatactacattttattcattgttctcctactgataaacatttttcaatgtttaagtactataaataatgctgcaatgaacctccctgtagatgtgttgttagacaaatgttctagcatctttctgggacagacatctagaaatggaattgctgaatcatcatattcatttttacattaatatttcaacctataaatgttttcaaactacatgagggaaacaactaagctcttttgcctatcaaagttactcagcatataacctgtactttctaggatttttttttttttttttttttgagacagagtttcactcttgttgcccaggctggagtgcaatggtgcgatcttggctcactgcagcctcgcctcccaggttcaagcgattctcctgcctcagcctcctgagtagctgggattacaggcatgcaccactgcacccggctaattttgtagtttttagtagagacggggtttctccacgtttgtcaggctggtctcgaactcccgacctcaggtgatccgcccaactcagcctcccaaagtgctgggattacaggcatgagccaccgtgcctggccattctaggaaatgttaagaaggagcaagccatccagaattggagacaggagagtattctgaaacttttagccaaaatttgaacttattatttgatcttcagtgagttttatgttccttcctcaggctttgttattttgcttttgaagtagttaaaatatgtatatgtccccctttaaatacagaaatctgattatacaaacaatttcatttaaagagtttacagaaaatcggccgttcgtggtggctcacgcctgtaatcccagcactttgggaggccaaggcaggcagatcacttgaggtcaggagttcgagaccagcctggccaacatagtgaaatcctgtctctactaaaaatacaaaaattcgctgggcatggtggtgtgcgtccgtaatcccagctacttgagaatctgaggcacgagaatcacttgaacccgggaggtggaggttgcggtgagttgagatcgtgccactgcactccagcctgggtgacagagcaagactctgtctcaaatataaaataagagtttacagaaaatccttgtacataactcaagggtctagaatttaagaaataagtttagaacagaatttagagtgtgaaacgaccataaagacttatctagttcagtcttgatttatagatgtgacaaatcaaggcacagacaacttaaattatttacttggattcttctgattgctagcagaatctgttgaaacacacatactcaaagtccctttgaagaaaacagctttgtttgtaaaccactagaatctttgcaacagacatttaatactgcacagtgacttcttttgtttacctcttgctatttgacctcagtaactcacagaaatgccatgcctgttgttcaaagcaagtgtgaaaaaacagtctttgtttataacctgcttttgtggtgagaactgtagaagctcacttacccaatgtgacttggactggtaattaagtgaaaagttggttaaaggctttttcttggaggtgtggtccatggattggagttctgtattatcttttgtgcatacactttacccataatttccaggtggatttctttgaaatggctggagaacttagactttgtagagcatctgagagtgccaaaacctcttggatttttgtagagttcactcccaaccttttctaattttaatgcttatacctagttagcagtattttttttttctagaagaaacacttcatttaaaaaattttcccaaagctttcaacttataatatctattctagaatgtcaaagtcattgtaataacagttcaacaaccaggccttcagaagtttttatactatttaattatatttcataattaactgtaacaagtgtaactagcacagacagataccagaatgaacttggttgacccatgatgtgtagcaactcctgtctacaagctctgagcgttaggcaaaccataggctgatgggtatatgttggagggataaaagttggtcagctttctgatgactcagctcagtggaggttgcttaagagagctgctactgtatccttaaggggccattggtaaattttaggacaagtatcttcagggaacctaaagggaaaataaatgtgtgtgtgtgtgtgtgtgtgtgtgtgtgtgtgtgtgtgtgtgtgtgtgctcgtgtgtgaagccttattgaagagtagcaatagactctttcttactaggcgtaatcaagttgccctcctggggaaactcaaatgcaaaaatcctcttgaacttttctgggtagcctactctactctttcctaatagtaccactacagtatacagcactgtaaaattttttgctttaaaagtttgtttataaactggcatttataagtatactttttgagctgatttaagaatcaagtttttttttctagggaaatgcttctttgtaattatctgtcactagcaaaatttgttttaacatatatttttctaaaaatatgatatgtaaactgtgttgtagttgtacaattaaaggtttttggtcgaacagttattacatgatgtaaaatcatgtgtaacactttaatattaattacattgtaacctaaaattcattttaaaactttttatgtggcttgaacaggaattttcttatccaaagctttgtatgtatgctttattgcctcctttgttattagcatggagaccatgggttttctgttattgttgtttcatttaaacagttcatgaatatattaagcacctgaaagaaactgttagatgctgttaataggaagaggagttaaaaacctcgtccttgcccttatctacatgtgtacatgtagaacttactgtagttccctagatgtagcaggtgctcaggaaacatttttgtagtagtaaaaaagaaatgtcaaactctaacttgctctggagcaaattccgctagtaaacattgtttttcaagcttcttttttttgccttgcgtcctactttcttaggccaaaataattcatccacatcccaccttagctgtttttttgtgtcaaacaaaaatcttatttggaaatagcatgttacgccaactgtgttggggcatcccatactgtattgcattaaatgaggagaaagatgcagaggccatgtggggaggattgtgatcctgataagagtgggatgagggataacaacagagagactgccgttcaatatttctttctttctttttttttgagacggagtctggctctgttgccctaggctggagtgcagtggcgtgatcttggctcactgcaagctccgcctgccaggttcacgccattctcctgcctcagcctcccaagaagctgggactacaggcgcccgccaccacgcccggctaattttttgtatttttagtagagacggggtttcactgtgttagccaggatggtctcaatctcctgacctcgtgatccgcccgcctcggcctcccagcgtgctgggattacaggagtgagccaccgcgcccggcctgccattcagtatttctaattaattcagatggggaagaaaatctctagtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctagtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccacctcggcctcccaaagtgctgggattacaggtgtgagccatcacgcctggccaaatgaggaatttaagatctaaagaaggtaaatggtatgcccatggctacacagctaagggacatagttgagataagaattaattaaacacatatttgatagtacctagtgcctagtaccagtcactgttttagacactgcagatcggcagtgaacaaaatagatatgatccctgctgtcatagaacttactttctagttgaagaaaacagaaaataagacaggaataccatgtacagttaggtctctgatgaaagtagatcaggacaattcaccagagagctattgcggtgctgttgtgtattggatgaccaaaattgtgctcagattgcctagctaaacttgatggtttttacctttgcttttagttttagtatcctaatagaaaatgtttaggagaatgtttaatagaaaatgctttggtatttataataatttaaaactcagtagcatgtagaagtcagtaaatccatgaaagagaatctttcgtaattcagagaagaagtaaatatcttactccagatcactgtccttaactgtttcttctcatttgtggtatctcgtagtagcagaatggacagacagcccaacctgtaatatttaccattataccccagcacatagaagaagaccaaacttttagaagggactcagcaaagatttggtgaatgagtaattgagcattcagaagctgtctctgcacttgtagggcaagcattttgtactagtgatagaaaagcaggaattgtagagtcacagacccagggttgacttctggcgctctcatttactgtgactttgagccttgttgcatagcctgtttctgcatctcagcttcctcactagtaaaatggagtcgtagtttctgcttccaagagtgtttgtgaatattatataactggctgtagtgtttgaataaaatactaagaaactttattctttgttagaaatagtaaatgtggtactcttgaattactttaggtggcactctgacatttaaattagatattttttatccatgtggaagaaattttaaacatgagttttgcagtcattttgtaaacactgatcgtaagtgctaattcccttttcttcattggctgtgagtagtttgtttgaggagcagattggagaggagtatataagataaactggttttctgcatttgaaaaacattggtgatgatctgaggatcaaactattatattatgaagtgatttttctccccttacctcttttctacatagcttgtctttagcttcaatgaaaagctttttggcttactggtgaaggacattgaagccatggatcctagcatcctgaagggagagcctgcgacagggaaaaggcagaaggtagcttttatttctgatcatctttactagatcatctttataatgtaatttgtgcagattgattataattttcctatctgttgcttagtgatttttttcatattgtgtacccttttaagatagtagggagaaaaaattgctttcatagccatcattgttattaaaatatagcttaaaatgtatttatttgcagacctaatattaatgtaaaatgtagacatatatgtacatataatttgcttgaatgcagatatttattgtaaataaataataagaaacgcattattggaaagatataggcatggaaataaggcatgtaagaattgtagaagaaagttatgagaaaagtaaaagtagctcagatgatagtctggaaggtttgctttgcccagagagacctcatttccccctcacttttggccttgctttgagaagtccagaagtttgctattagactactaattattgtctttctctacagattgaagtaggactggttgttggaaacagtcaagttgcatttgaaaaagcagaaaattcgtcacttaatcttattggtaagatttacagtttttagaagatttgaaatgaagtgggcctatttctatatgtaactcaactacagtgatttccaaatggggaaaggaaagaggggcatctctcttgagagagtttatcacagaagcatggggtatttcctgttggtcagtttgctgatgaaaacgtttaaaaccttcatctggatcaactttgtccaatagaaatagagtgtgagccacatgtgtaatttttaatttcctagaaattgcactaaaataagaaacaaattaattttttaacttttaattttgagataattttaggttcacagatttgcagaaatagctcagagaatttctgtatgccctttaccagcttaccctgatgttaatgtcttatttgacattttcaaaagtacaatgataagaaatgaacatggtttcatttctgctaactaaactacagattttattgagatttcaccagtttttccattgtgtccttttctgttccaagatctaatttaggatcccatattgcatttagttgttctgtcttttgagttttcttcagtcactgacagttcctcagactttgtcttttatgactttgagaactggtcagttattttgtagaatgcccctcacttggttttgtgttaaatgagatagcatcatcatttcttttagtgattaagtgatgaatgtgcaggtcaagtcttcccagcagattcatggttcagtcctactcttgtactctagcacaatttttgtcatattaaaacaattgcagcttattctctgagaatagtaactcaccagaataatgtgacattaactgggcattaattcttatttttggttgatttaactatgttgatgtctaccctactagagagtagagggttttcattggttgcacatcatcatgtccagggtcacttaacagtctttgagtgcgtggcctttatttcctggtccacaaattaccattcccccttattgttttttgttaattataaaatattttatttataaaatatggataggcattcgaaaacaattcacacactgtaaaatttggttctgttttcatagttttgtaatttgctttttttgcttagcatgtttcaaacatcttaaatatacacctataacatgatttttaatgcctgtatgtcattttatgaaggtaggatgtattttcctgttattgatctagtacatttatgaagtgatttctttgtattttatttttgtgtaccttttgttaagatatcccaagggagttgcataactttcataggtatttctaagtaatccatgggaaaaaaattgtgtagttaattggcattcagtaaattttgcccacaagagggcagtagagtgtaagaaaaaaatatttttcatcgctttccaaaggaaatcttaaggcctcaaaactctaaccataaaattatcatctagtataaacttttaaaaagcgttactttatttttaattgacagataataattgtatatatttatagggtacaatttgatattttaatacatgtatacattgtagaatgatcaaatcaggctaattaacatatcacctcaaatatttagcatttcttaggataaactttttttaatgtgacattttcttccctggttttataaaaaccatattattactttattttttgtttataatagagcatactaaggtacttaatttattctttgtttgaaatagtaaatgtggttctcttgagttgctttaggtggcactctgacatttaagttagataatttttgtcctcttgagaatttttaaacatgagttttgtaatcattgaagtctttaggatgatttcagacttttgtgtccaagtgaagagaaagcaaagaagacatcaaacttgttcagtatatttccttaggctgaggggttatatgcccaattacctgtataagcttaatctggataaatatatgtattttaaaataaacttgcgttaggagacttcagtgactgcgagatttcagttgcatttctgccagctagtgttgtcttcatcagatatggcatttcttctgatcaaccgagttagttaatttagttagattgaaggttaataaaactaagttttatggactgatacaaatagactacagcataagtttagctagtcattttgacagtgtgttaccatatatggagatcagacaaagtagatagcatagcaaaacttacccttctgactgtaaaatcagctaagattatattgttcgttttgtatatgtaagggtagcttttctttattcatttaggatgctcagggagttctgtctgtctttttagacttagtgataaagtccttgtttcacatttgataatattcgtttgacataggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggtaagtttaaaaaggaaaatgttataaaatcttgtgttgttaaaaaaattaatgcaatgaagaatctcttttcaatagttttgaaattatttttcagacccattatttttgtctttttctttaaaaatgaacagataaattttctgaaaaactttataataccagaacttttaaaattacattttaattttatggggaaatcatagaaataagacttgtggtggctccattttgtttatttatttattgaagaatgcttttctatggggcatatttagaaacttcccctgacagtaataatactagtagtgactccattttatttatttatttgcgtaagaatgtttttctatagggcatatttagaaagttcacctgactctaaagatcactatgggtcagatgtaccctgctgaataataactatctattaggctgtgtgcattgttctgacattagctgccgttcctttttattgtactgttgcattacccagttagtacatcttcatacctaataaatgggtacttgcatatttttaaattaaataagtttgatccaaaaagacaaatgcaggatatacattggagtttctatattgcatacaaagaagtgcactattcgtttaccactttcttcttgaaggtttatttaatttatctgtgtgaagtgactttatttgcccagtggaaatgctgtcatgactgttttcatgtccatatcattcgttggattggaatgtgagcaacagaatatctgagaaaggaatgtataacataacagcttctggcagactattagtgtaaaaacagcatccaaaaaaaatggaaggaatatgaatatattactccgctcatccccatcattctttatctttaaattgctactggaagataaaagtatatttattatagtggggataagaactgctttctaggcactaagtgcttggattgtattagccttctattgttggtagcctttctgcctggtcgctcactctgataaattacaggcacggcacacacctgttcactgagtaaaggtcgagtttggaattggattaagagaaaatgacagagaccctcatcacctgagttttatacaccttgaaatggcaatagcatactttttatctcaaagatacaaaggccacgtccattaaaagcagaattttaattgggaaaatattttaaaatgtggtagttcactatcttggtaatgtgtattttcgatcaagacatgaaaatattgtttaagtgtattttgggtaaaagcagggataaaaagatgattccaaatgttgtaagttattcttgtggaatgtttttactggttttcagaactgagatctagtgcaggaagagtctaatgattctgtttcttagaacatttatactgtttagccaaaaagtagaaaaataactgcattggtagtaagccgtctcttttaattataaatgttttctcactgtttggaagctattgaagataacagttattcagatactagtttgctatttgtgcattatctagatcctgcacttgaagctacgcgcaacgtcagtatgcgttgggtagataatgcgtaaaggagttggtctcacattggtcagtttgtgaccttgccagctgttggagagttttaaattaaatcagaacagatttggaatttgttagtgaatttcatctgtttctgatatccgtattgaaatgagctgaattacagtagtgtgctttttgttgtttttgatgtgttttttgactaagcactatggatttgaattttgtgagtgccactgtccagaaccttttttatggatttatttttctaatatttttacactaatttaattagacaaaaaatgaattctatccttttggaaaagttttttttttttttctctttatggctttttgccatcaggaagcatttgttaccaatttcattgaaaagacaaactagtataaagctgtcctggcttttgagctgaattgaaaaacttattttctttattctggatgaagtttctgggtatctaaaaaaaagtaaagcttcttcttttttttttttttaatggttaaatggctgagaaataattcttttgtaatgcatgtataattccctgtcttccaatagaggcttcttttttcctttgaattttgggggaattatatagtaaaatcctttcttgcactccaattacagtgtggttataaagttctccttaggctttggtaaaggtatataaataaaaatggttatattttgacagaatataaataaaattatacaaattatttttatgcatattctgtgttgttttttttttttgacatgtcaggtgggaacaacatggatttttttcccccactctttgttaactaaatagacagatctatatggtttggggattcagctggacactgagtatgactggttaaatcagttctaatttttaaaaaagattagaaaagaataatttatgtaggttatggggcttttttgttttaagcagaaaactttacttttggcttgagaccaaattactgtctttaccatggagtctaaagtgatgtctacttcgtaaacaggaatcttaactaagtggattttttgcctatatatcaattttcaaatttacaaagtgataaatttagaatattcttctcttctgtcattatgttcatcagactgataattatgcttctaggtaacagagttctttctttttgtctataaaacttcatgttgccttttcaaaattgaaaaatatagtttagctacgaacagaatgttgctgatgagatataggaggactaaaggacttaacgagaggcacacaattaagcagtaaaattagggaaccaatgaggtaatatacttgaaaataactgtcatggagtttccaatctgttagtttctctcttgaaggtctttcaaataggtagtgtataccttaggccgggtgcggtggctcactcctgtaatcccagcacttagggaagccgaggtgggcggatcatgaggtcaggagatcgagaccatcctggctaacacggtgaaaccctgtctctactaaaaacagaaaaaattagccgggcgtggtcgcgggcgcttgtagtcccggctcctcgggaggctgaggcaggaggatgtgtgaacccgggaggcggagcttgcagtgagccgagatcgcaccactgcactccagcctgggcgacagagcgagactccatctcaaaaaaaaaaaaaaaaaaaaaaaaaaaaaaaagaagaagataatgtatgcctttctgcttttgtacttttgttatatttttgtagaattaaaatcaaggaaacccttaaaggagaaaggaagtcacataaagctctctagactgagggataaaggaaaagggattatttaggggaatatcaatttagacttttgtttttgttattgttttaatcagagtaactgttgagttttccccttgtctgaagcagttgagctcacccaaacccaagtggggcagcccttccttggaaggatatgagagcaacgagcgaagaaaactaaacctataccttgcacttagtaaataccaaatagatatttagttagaatgccttccaaccccccacaaaacagatttttaattaagaattaccttaaatccataattttatgggctaatagaagccacatttgagtcccagggtagaaatgtgaacatcaaagctggtatctggaagtatgggtgaataaattcaacagctgattgctgtctttcagcatattcaggtgttaactgaatagatactgaatacttgtgttcggacatttaccacacttattcccctgtatgcagttttgtggacagtgttcaggataaataaatgattgattacctcagttctcactgtagctattttgttagcaaagatagcgtttctgccaagaaacttcattttttcagcatccctggcaattctctctaaattataaatgtcaaagcaaaaaaacacatcgttttcaatgaacagtggaataattgttaaagaattagtcagcatctcttaatgtaatcctgggaataggttcacatctacccaaggaaagacctagaaggaaaaggatgtaaagagggaagacctcagcctcacactgtctttcagtggatctgtggggtgtagatgttcaggccacctagtggggaggaaagccacttgttatggtcttgtgcccccattctttgaaactgacactgtgttctttttggtctcctttccccagtgtctccctctgtaagcccattttcaatcgtatttttaaggtttcttttgaaattcaagaggaaagcaactcttttctgatatcataagtgaaattgtagttactctatgaaacagaactgctgagaagataaggaacctttcaatcacacagacatctttcacatactaaaaacagtgcaaataaaacatagtggaagaaagggcactaaggttttgtgcatgccatattttggagagagggagttcttgctaagattaacataaacactgacactcttaaaatgcattttcacacccccactcatgaggagagattgcattttaaatgggggttaagacatccaggcgaactccagggctctgtaaaaggaaccctaaggctaaagagcttatctgaaatttgaaaaaaagaaaaaaaaatgaagccttctgacattcatctttttttcttgtattagtcataacttgcttttcagctatattttaggttttgaatgccaacctgacatctgttcaagtctgcctgtaatttattagcagaggaaaagacagcagttgctcactagttagagatgcaaaatttctgccttcctgttctccactaagtacttatagatgatacctggatacgaagaatgtaataatttactgaaaacttcaggtcaggaaatttataaagatttttttttaattagaagaataaaatggcttaagaccatgtgatttcaaaaatctctagatcaggatttagagacaaaacatagaccctaaaaaatactttagataactttctataaattgtaatttttttaaccttgaattaatttttccattggttttaaatttttaagttaaatgtatatttgaacagcagttgtgcttatatctgaaagtcaaactgtatgtaaattcacctggcattttgcatttatagacagactttaagaaacaaatcttttggagaggtagtgctgtctacagagtcaccaaatggattagatttcctggcaactacagttgagttacttacagatcaacagttgggtcactacaaagttgagatctaagtgttaacctgagtgcccaccagtaagaaaccggttagaggcaatcttaaaatgatatagctccaaatgtagagacatgtttgtgttaataaaaaatatataaaagcaaatgcattctaaaaatctctaaggacatacattaaattgaaaaaaggtttatggctgaatgtggtggctcacacctgtaatcctagcactttgggaggctgagatgggaggatcacttgagctcaggagttcaagaccagtctgggcagcatagtgagaccttgtctcatttatttatttttttaatttaaaaatttaatttaaaaattaaaaaaagtgtttacttccatggaagggaagctaagatggggaataaagggaaagttttgttcttttactcaattttacctttatgtctgaatgttttattgtatttctaatgtgtgattttaaaagccaacagacaaaagataatatcacagtatgtttcttggggtgactctaccatcagcatggaaagtcagcaggaaacaggtacatccttccgccttcatgaagttttctgtggaggaggagagtgcagggtaaaaggcctggattccaagggctttgctggcagccccttagagggtagacagaacacctatcctatttggtcaagaagagaaaaagtttctccatatataacaaactgctttcccccagaatgttctgcattatagtaatggtgtaagtagtctgcccttcaaacatgagaacatttgcatccaggcctttaggcagccaaggcagcattaaagaagaaagagtgggagcagagcaagctgagggagagcagagcttctgacatttgaggaactgggcgtgaatttgtttttagtcttcaaaaaccattctcttgaggaatcgaattcccatgactcctgaagtgaagcggttggtgttttctcctgcgttactcccatacgtaagttggtgattataatgagggtggtggctaatacttatataatgccagacgctgttctgtgtgctttattattgtgtttattaatcctcacaacaaccttcagaagtagacactgtattgtctccatattatggagcaggaatctctgtctcaaaaaggtgaagtaatgggtccaagacacacagctagtaagtagtagagtcagatttgaacccaggcagtcgagccccagatttcatttccttaaccattacatgttattctcccatgaaagcccatcgtgtaaaaccattttaatgggctttctagcttcacttttttggggacctttgaagcaatcattgaggcagcctttgttctagccaagggccaaccatggcaccattgagattttgagctgtataattatttggtctggggactgggtgtcctttgcattgtaaataactaacttttctagtaatctgatgtgttcaaattgtcatgagctcaagagacatgaagatttggtggtaggctgtaatacctaatgccacttttttcatgtgttttttgtcacgtgttgtagcagaatacaggaaggaaggaactggaatgggtgtgtcagagaagctgtcttaaactgtcaacctggagagggaacataaatgttaaaattaaataatcattaaaaaattaagcaacgtaacaagtgatatcaaaggccagtatttgattaagtgccagatgagcagtacaattgataagccctacaggaactgaaagggaatcacatcgagaagacttcatagaagaggcagagcttgagtaaggccttaaatgctgagcggttttggataggaggagggaaggggatagttgtccatatcctgggaagagtgacagactaaacacggtatagacttcatgacttagaccagtctaacagagctgttgtttggaagaaacaggaaataggattaaaaagttagttttgggttgggttgtggaaatctgtgaggagatgtggactctttttaaagtactgtccctgtttaagcttccagacagactcagaaccttccagacagactcaggtgcttctcctgtgtttccctgcaccttgtatatacttagaatccagctgtgttcttaatgtaattattcatttgcattacactcctaaggcagaatttcttaaccttggcactattgacattttaggctggataattcttagttgtagggcgcctgacctgtgcatcataggatgttaagcgccatccctggcctctacttgatgtcagtacttcccttcctcaccactccgagccccagtgacgattaaaagaaatgtgatgaaactgtcctgtgttgagaaccattgctcaaaggcctttgaaggcacaactgtaatgtcttcttatccatgtattatcaacatcaggggtgttgggatgtaggttgcaggtcattgttggaccatgaaccactgttaccagtccacaataagacaaatattggaaattaagaataagtaattacaaatgtttatagcaatttgacattatcacaatttttttaaaattatattttacaaaaatgttggtctgcaatggattggaaatttaaaaggaaaaaaaatacagctggaccttagcatacatagtttgagaagcactggcctatgtaaatatttgcaaaatgaatgaaattttttgaacagatgccttagagaaaaggtgaggcgaatagtcttagagaccagtagactattgctgtccagtgtgtggtacttagaatctggattggggtgaaggcaacaggaatggaatgggaagaaaatacatgaaaaaattgcagacatgaaactggcagaatttggcaatagttattgtgggtgacagaattggaggtgagactcaggtcttgtgagaaaatgttggaaatgagaaactcaggagaacatagttttggaaaagtagagaatatcattgcacatattttcaatatcgtgaaaggaaactggaagctgaactgaagagaggaagaattactggcatttcaatttattgaagcctagcttcaatcagtctgcacgtgtttaggaaacacactgttgactacttttgcttgaaataccctctttacttggcttttctcactccaagcatttctggttttccttttacctctctggctgtctcttttcaacctcttttgtgtcccttaaaatgttggggttcctcaggagtctgtctttgacctattatttttctctaattattctcctccaaattaatcacatctgtttcatagcttcaattagtatctttatgctgctaactctcaaatatgcatatgccacctcggtctcagtttagaactctggatttgtaccagcataatgtgttgggtatttcatgatcacatagtaagcttgaaattaaacacattcagttgccccctcagtcctctctaaacatgcatctatatctgtgttttctatctctggcaatactctagccaaaaatctggacacctttaactcctctctttccctcacctcccacttccagtaagtcgcagaatagaccgtcaattctgcaatctccgcaatctctctgaaatccctccagttctctctacctcgccctgccactcttccttcaggacaccattatctcttgcctgaattgctccataagccctcagccttgcccttctctaatccattctccacactgtaactggagtgatttttataaaaaggcaagtctgatcctgtcactgcactggttcaaactctttagcagcccgccttaactccttacatggtttacaagccctgtgtgatctggctcctgctaaactttcttgcttcgcctctcagcccgtgcccctcccccatactctgggttccagccagcctgtgctattttcagttcctctaatttgccatgctactttctcttacctctatatcctagggttatttttttttgctttttttttttcttaaccatcttttcatccaattcctgttcactcttcaggccaaagctttgaactcactgtttctagaatgagtaggctttaatgttcctcatgtgtgttctaatagctccatgttattttatgcattattacattgtattataattgcttattacatgtctgtattccaagtcctctctccatgtccctgccctcacaaacatagtataccttcagtaaggaataggccttgtttattttggtcactgtcgtattctctcctcccggcatggtgtctggcttataagttttcaggaaataaataaatgccaggaacttgattaatcttgattaattaaatagaacacttagacagtttgatccaagccctgccctcatgatacttacagtctgtgtgggagtaacactgtatttgcacatcccaaagcagtactgtgtaaaacataaggtgcattgtgaaccagattagcaaagtaggccacatggagaagcagcagatgcatttaaagagcaagactgagccatatctttaaaagtcaaagcagatatgatgtttataattcattactaaatccatgtagatcctcttagattctgaatttaggaaagacctcttggattggtcctgaatggcactaggctccagaaataagaaaaggaagagtattttcttgggtacttgtgagctaccatttgcttcattgggaactgccattcttatgtaagggcactataacaagagtgttcacatttaagggcatcaggtcaatattgcgtctgtgtgagtttgtgtgcatgtgaatgcacacatgtattttctatttttaaatagaaacacattataaaaataatgcatcctcataaaacagcacagatagagtaaaaagtgaaatctcccttcattctacccactccagttttactccctctcttagaggtagacactgtaaagagattggtatgaatttttcaaaccctttcctaagtatttatacaataatatataatcaatccattcattcatttattgagacagggtcttgctctgttgcccaggctggagtgcagtggtgcaatcatactccattgcagcctcgcactcctgggctcaagtagtcctcccacctccacctgccaagtagctgggactacacccagctaatttgtgtgtgtgtgtgtgtgtgtgtgtgtgtgtgtgtgtgtgtgtgtgtgtgtgtttgtgtagaattggagtctcactatgttgctcaggctggtctcagactcctggcctcaagcagtcctcccgcctcagcctcccaaaatgctgggataacaggcatcagccactgtgcctgacttttttttttttttcaacctagtagtgtatcttgggtttttttctgtgataaagcacacagataacattttattttttaaaaagttaaatagtattagcagatctgcatccacacaagtcccgtcatggtaagttagcgtctcttcctcagcagtaagaaggctcctaggcacacaccagaacaaggttggcattgcgtctcctttctactcacttgtatggccctaggcttctcaatgcggcagggccctgggcgctcagctacttgagccttggtacccttgcctgaaaaattgtttattggtaggtaacattaatgtgtgtaagttttctaacacagtacctggctgactgtcaaacactccatggatgatagttacttggtatgattatattgccaagaggcacttttggagctctgtaaaaggcaaaaatttataacccaatccctttaatctaatgttaagatgtgttttcttcttatcttaaattttgttgctgttgaaaatagttaacacctgagattttcctcctatgctgttttataattacccattttgaacagtgtttgttgataaggtagtcaaggggacacttcgaaatattttttctttatttgtgaagtcatactttggctgatttatatttaatttttatcacattacatcggagaggagcagataaattttctatcacctctataaattttctatcacatataagaaagtgtatcttatatgtgatacactaacttggaaaaacaacagctatcttgatagacacaatagagaataggatgtcagaggaagagaagaattagaatgttaacaataatgctagtaaaaagctacccaggacttaaatggtattatttgagagtacttctaccatgattcaaataagacttgccttggaattccatatgatttgttacttagagcagtctacctttaatatgtttaatatggtcatactttaaaaaaaaaaacctgcaagaaacttgggtttcacgtttttgctttttaaagaattaacataatgttatttcaggtttgtaaaggaagttacagaagatagcaataaatcccttccatataccattttagtcatagtgcaaaattaggcattgaaaattattatgggtactgtattagatattcaaagatttatttgtggctttgacttctttaccaacacctctggctttaatacagtatcttttatcagagcaagtaatagtttgaatccttttcttacaaatcctctttttactcaagtgactgcaaacttataaagatgcacacatctgtagcttgaacgtctatgctatttgctcaagtatttacttgaatttatcctcgatgatatgatttttttaagtgctttgattttaaattctatctagaatcccatcatgagggagaaatcttagcaagacttaagcaccttttcataatgactggttactgtaggataaacctataattagtatattgctaatccacacgttagatatatcccatcaaatttcaaatatacacaggagaattatccacattgaaggttattagtgcattccagggacatttccatgttgattcacaactacccctttaccttacactttcctgtgttactagacgtctctttctgtaaaacttctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaacccttttttttcatgttatctagaaatgaatctttaaaaaaaaaaaaaaggaatgggttgaacttataatattttagcaactcataaaataacttgaagaaaaagatcatttggaaggagagacaaaacagactgaaagacattgtttaaatttatgacttttattatcttacttgaatgctatttttgcccctctcgctattattaaaccctttgcttcctgttttcagttgctcctgtcaaggtatgaatttttctttggatgattgtcatctatttcatattatctagtattcctctctattatgagaaaatcaaaagtagacagtgtatctatagctatagatttaaatgcactaaggtaattatatatttgaatcagagacctaaggaataatctagtgtagcatttaccaaatttatttaaacttaacatgcttacatgaagacagacctatttatgtttccaaggaacaccagtttgagaaatgctgatcttacctgtgtcattcttattttgtagatgaggacattgggacctcagaagaataaggcaacttatttaggctaaagtcactgcttgtctactggggctggaatccaggttgcttagtctggtgccctttaggcttcatgattcagccacttaagacaatttgatttattgttgggctttttaattctagatttcataacttggatatgaaactgtacttcccagtctccaaaataagcttcactgttttctggaacgtgaattagattcagaaagccccttactgcctttagattattgcagcctccccagtgggccccagggatccaggaaaaatatctttgtttttcacctagtcctctcctcagcttttagagggactcttagatctatgtttatgaaaagacttttattagttcttatagttgtagtaatgcatgtttattgtagaaaatttcaaaaatgtagatgaataagaagaataaaacaatcactcagtgtaaaaaacaaaaaaccctgaaaaagtaccattaatattctggagtatatcatccagctagttttagctgtatatacatagagccaaaaaaaaaaaaaaaaagcattttgctgttttataactggttttctccccactcagtaagttaacagtttttcttaaatattctctacaacattctttattttgtagaatgataatgctgtggtttgtttaatcaatcccctctagttagaaattgtattcagttttttactattatacactatgtttaacaagcaccttagaaactaaatatttctacacattcatatttctttaagataaattcctggaagtagaattgctgaatcaaaaaggattcacaagtgtaaatgtttttgacatgcactgccaaatttagacttcctttttgaaaagtcaaatgttaaggagatcaaagcaatcactaagcaggtactctggaagagaaatagaaatataaaaaatataatggtttcatgagaaactaatagacaaggtttcaagagacttggagtctagttttggatttgtcattgaatggctgtgacttttgggtcttagtttcctcattataaaaatgggaagatagactagaaatagaaactttttcagaatagtcaccttatgaatgttgtttcagtgaaatataaaggtctgtacataagttctgcagggaagatgccatgtatttgctcattcttcaagtttcagcttgattgcctttggaaggtctgtcacacttaacgtcctcctaatagaagtaattgttttactttttggctcctcatagccctttttaaatgttggttctgtatagttgtatctttgatttttaatattgaggtatttgtaacagaggttatcttactcatctcctgaaagcacttggcttagcatagttcttgggtatataatagagactcagtaagtatctgtggaagttgagagtgataccttgttccccagtgtataacagcaaagcctagcctcctcctgttgagcattgtctgttctcgctttgaagagctcaccacatttcttcagtttgtttttgtttttattttattttattttattttttttttttttggcggggtggggtctttcctattcagtaacacagtggttctcagtctttggtgtgtatcagaatttttttttttttttagagttttgctctgttacccaggctggagtgcagtcgtgtgatctcagctcactgcaacctctgcctcccaggttcaagcgattcttgtgcctcagcctcccgagtagttgggattacaggcacatgccaccatgcctggctaatttttgtatttttagtagagacagggtttcatcatgttagccaggctgcccttgaactcctgaccttaagcgatccacccaccttttctggtattacaggtgtgagccaccctgcctggcccagaatttttaatgttaaaaaaaatacagatttccaggctctcaagtacactgaatgtgagtgtcaggcacaaagccgagacacagcgctgtcaatagctgagctctccttggggttttagctttgtcaggcaaattgatattcaagttccaggtctgccacttaccagatgtgtcttccccttaccaggggaaggtcactttaccactgtaagcctcagtacctcttccttaaaaagagggtaaaaataataccttagctcatagttttaaaaatgattacgtaagagaacatattaaaacacgtagtatagcccttcccatatctgcagttctggccttgatctgtaacttcttggatcttatatgcatttattatttatttgtttctttttaaaataacatttatattttttcaacttttagaggttaatatgttcattatagaaaactgaaaaacacaagaggcatataactaaaaaatcatccataacagaatcagtttacattctgatgtatctttccagtccttgtatgtgtatacatatatacataactgagtatacctttttacatggttacacttatatagtatgtgccatgctttcttgcatatcatgagtacttgagtatcaaaatactcagggctttaggattcagacattggtaaatattcacgatacattttcttatcttttgtggggacaaaaatatcttaaaaaacaaaatggcaacaggtctctggaaatgcatattggcaggtttatagttaaatactgtgttcacttaatacccaatataaaatgagatacaaagcagtcaagtaagtataatgcttcttagatagttcagtatgagatctgcactattaaaatattaccagaaatgatgtttctacttaattatttaacaattcatatagtattcacaaagtataccaaaaaaaaagcacacatatgtcagtggttataatcagattgtaaatatggacatatctatatatatctcttcccttacctttctttctgccccttccttagcaatccagtacgtactgatgtatactgctcataggtggtttaacattgccatttccaagatgcttcttttctaatgaaattaatttactatctagttaattcactagctctattttatacattgtcacctcataacatctagaaagcttagtgttgtgaagtaaggactgataaacagaggcactttactaaaaaatcacttcctagaactgtggctacaatatgaaactatcttctagatatgaacatacttgcaaagaaccttccttttgcctttcttcttccttcttcagctcaatgaataagtacagaaatgcatatagctctacgagatgggttaacaacagtcactcccagacaacaagccttgctaaaaactctaacaagaggacatttatcaaagaatcattttacttcttaaactttcagcatactttgggcacttctcagcattggggccttgtttgtcctttgcatactcaacaatgctaagtaaatgcacttgcagaacgacgagtagataatctgcatttatctcaaaacacactggcacagaactcttccaccgtcacttcctgtctctcccacctcctttactacccaatgagcaaagaatatgtagctcaaagagataaaagtttaacagttccattctaaagacagtcattcctgttaattgacataaacttacttaaagtgtgttattttgtgaagactacatgtttcaaacgtctactgtataatgatagcattgattaaattgtgtgcatataacaaaggctataatctgaaagtatcttcgaaatatgaatattatagccaagtacacttcaccttctcacttccttcttatcattatcagcccaaaggacaatatcagcgttccagaagttgttttcagaagatagtcttacctatgaagttttcgggcatacaagaaaagtatataatatgttttagttcatcatctcttcttttgtcaaacattagcaacctctttatcatctagacaacaagatgtaaaattaggacttgcttgttcattgtacagataaccctcaatgggttatgtctcagcaaacccatcgtaagttgaaaatatcctaagttgagagtgcatttttgacttacagtattttcagttgactatgggtttatcttgtcgtaactgattgtaaatcgaagagcattaccaaatgcatattgcttttataccatcataaagtaaaaaaaattgttaaaagtcaaaccagtttaagtcggggaccatgtgtatacactatgtgcacagcaaagtaaaataaaatgcacagaacatgcaggtaatcttgcctaactacaaacacatggtatagaaccctttattccttcctacacttcctttgccttcctcctccctcagtccacaagcacagatctgtaccactcaaagaggaggtctaataatcccatttccgaaagacagtatttcattaaatttattaattccttttatccaggcatttagtggtcatttttagatgacctttaccacatatcttcagatgctttcaccgtccgccataagaatttttactgaaatgaattcttgaaatgtttaaaactttgttacattctttctcgttccacaagtagttatcccttcccagttacctttcttttttaggtctgtggagtcatgatacatctatccccttttcctttgtttttcatgcatttgtcaaatttattattgaatactcctaaattttttctgcctttatcatttgttttttctttttcattgctttagtcagttacccttgcactacagcagtagcctctttattatcttccttgcctttagtcttcttcctttccatcctggaatatttatttcagagcttactgtacaaaaataccagattctatcagagaacattaaaggaatcacagaatctcagtattgcaaaggatcttagccatctagtgcacacacctgttttttatttgaatctcttctacatttctttttattattattattattattattattattatttttgagatggagtctcactctaatgcccaggctggagtgcagtggtatgatcttggctcaccgcaacctctgcccccctggttcaagagattctcctgcctcagcctcccaagtagctaggattacaggcgtgcaccaccatgcctagctaattttttgtttgtttgattgtttgtttgtttgttttgagatggagtctggctctgtcgcccaggccggagtgcagtggcatgatctcggctcactgcaagctccgcctcccgggttcacgccattctcctgcttcagcctccctagtagctgggactacaggcgcccgccactatgcctggctaattttttgtatttttagtagagacggggtttcactgtattagccaggatggttttgatctcctgaccttgtgatccgcccgccttggcctcccaaagtgttgggattacaggcatgagccaccgtgcctggccttttgtatttttagtagagatgaggtttcaccatgttgcccaggctggtctcgaactcctgaggtcaggtgatccacccgcctcggcctcccaaagtgttgggattacaggcgtgagccaccgtgcctagccttttgtatttttagtagagacgaggtttcaccacgttgcccaggctggtctcgaactcctgacgtcaggcgatgcacccgcttcggcctcccaaagtgctgggattactcatgcctggccctcttctgcatttctgctgagtaacttctgccaggttccttaggctaagcttaagttcctccagtgacaggaatctcactccctcctaaggctacattcctcttttggacaactataggtttaagtttagtcttccttatgttaaggtaagatgtatttgcttgtatcttctcctacaagctctggttcttcccctgaaactacacagaacaagcatgatactacttctttatgaacactctttaggtatgaagaaagctattgtccagacttccctgcagattcctcttttctctaagctaattctcctaagcttggttggttttttctagccagtctttttagccctttaccatcctattcacgtttctgtgaactttaacatttatgtatattaatgttaagctgtgaaacctagaatttagtggagtaatgcaaatgtggtctctgttgtaaaatagatcagaactatttattctttatttaaaacactagtcctttaatgtaggccgaaattgtgctaacatttttgacatcgacattctatcttaatgcttatctaatttactaatgaatgaaattcccagtcatctctcacaaaactgtatctcccccagctgtactcaagtacagaaaacatctattcttgataacttttatcttgttagaatagctcttttctcttctatagctacaacttgtcagtgtgtccttatcagcttatgatttaattgaggctatagaacatatacacttaaaaaaaataagctaagaactcttagaataaaacaacataatgtattgtcagttgtaaccatgaatgatgtttttcaaagtgtgtcctctggcctacattagagttacttagggcgcttgttaaatattcagtttcactccagacttaatgaattcagatttctaggagtgatgtctggaaatctgcattttaacaagctccattggacattggtgcatattaaaggttgacagctgctactctaagtactgaaggattgagcccaaagatatgatcagaattaggtggcattaataaaggaggtgatttctggggacagaagaacatgaactgttagagtaggtagaaattccaggtgtagtaaagaagaaataaattgtctgctagggaagatatttgctaggctgaattaggggcccaatagaacagcacataaaaggagttaaaagctaagggacggaaggaaaaaaaacaaagaaagaaaaaactataaaattctgaaaccagtaaagatacatgctgccatttggcagcaaggcagacctgctatagaagaagcatgatctttgtcatcaagaattcatgaaataccaggcaacaccctatgagggaatgtaaaagggtgggggtgtcagcaaagattagtttggagcattgctacacacatctcatctttagttctaggctatctaatgagaaaatctatattaaatctaagttgactgatttggatatagaccagtcggatggtagacagcttgcacagctgcttggtgctcaggaaataggctgttttcactagcatagcaaaactcagagtgctcttggcattttgaagttggtgggacaacagcaagtctctaccagacagaatagtgccacgaaaatggatggtcaaagtcccgactgcccagatggtatcaggagtagtggtcttggtcttaagtatttccatttcttaaagatttcataagtgcacagataaacaagtgtagatgacaacctattttagatgttgattgagagtcttaaggccaggcgtggtggctcacacctgtaatcccagcactttggaggtcgaggaggctgatcacttgagcccaggagtttgagaccagcctgggcaacatggtgaaaccccatctctacaaaagaatacaaaatcagccaggcatggtggcatgcacctgtgatcccagctactcgggaggctgaggcggcaggatggcttgagcctgggaaatggagattgcagtgagctgagatagtgccactgccctccaaagcctgggcaacagagtgagaccctgtctcaaaaaaaaaaaaggtttttgaaacaaaaggccctcctatataatgagtcaatgaaagttatgctcttagagtaaataattatattgtactactgaaatggtaagtcaagtagaactaagaaaatactcatgactctagttccaatttacaattttcaacagaaccataagagaagttgtaattatggaaacttaaatgatcaaatattaatttgtgtccaggcgcagtggttcacacctgtaatcccagcactttgggaggctgaaatgggtggatcacctaaggtcaggagttcaagactagcctggccaacatggtgaaaccccatctctactaaaaatacaaaaattagctgggcatggtggcacctgtaatcccagctactcaggaggctgaggcaggagaattgctagaacctgggagacggaggttgcagtgagccgagattgtgccactgcactccagcctgagcaagactctgtctgaaaaaaatataataataataattatgattatatttaaaagatcaaatattaatttgtgattatattttctacaagggcatgcactatttaaaattgagcactcaaatctggtttgcacaactgcacagagaagcttgcaagactgccgaatatgtcctgacttgctactagtcttttgatagcctccttctttggcaaacatggctagtctgcatttgtactggaagccacttgggattcctctttaaacatcagtcattgttcaaaacccacttcgcacttctttctctctttatagatcatgttgcccccaaaatgaactgaacactcttatcttaatgctaatttgacagagaccacttctaatttattatcatcctgcttactcttatataaaattagtgtttgctatagttttttctccctttgaatacctcaaagttgactgacagtttttcctcaacgcagcttccctctgataacatccagaaaaaatgaagaaaatatactgctttgtaaaatagaagagcttaacaagtacaaatttgtcacttttttcgggtgtttcgaaagagtgtaaacagtaaacattgctgtttatttcttgtgtttcagaagtaaggctatgtatttttatcgagctatttacaatttacatataagatgtaagtattttcatgaatcattttcatcagtggggtggatatacctatcatagtggatacggtcctattctgacttttagatcagaaatcactttcagttatttgtagcacacaccttaaagcctattaaagttctccccaccaaaatttgtattattataatcactggatgtcaacacctgtggctcaaacagtatccaaattttgtatattgttggaggattgctgatttaactgagagttgtagctagaaataaggtgagaaagaatatacaggtaatactaatccacctcaaactaagaagcaaaggatggtggatgggctatgttgatctagcgttgcaaaaacacttttggatgaagtgcccagaaatagccccagttcctttcactagaatcagcttgtcccaggtgaatgccggcagagcagggtgtgtgctccccaagaaagggcagtgaccgctttccaatgtctggcagttaggggcgatgagagtagttgcaattggcaagataaaggggaactttggaaaataaatatacttatgatagaggaggcaggagaaaaggtcaagggctgtacacatgtggaactgataatcatggtagcttggcttctatgaatgggtacatgttgacccttaagtgagcttagaaagcttgagaaatcagtatgcgtgaactgtttgaggcataagaaaggcaggattttaaaactttttttttaatttgtgcaaatttatgggatacatgagaaattttttacatgtatgtaatatgtagtgatcaagtcatggtattcaagggatctgtcaccccagtacaatatattcttattaagtatagtcatcctaccctgctatcaaacattgaatttattcctcctatcttactgtacgtttgtacctttagcctacttctccttagcctcccttcatccccagtcaccctccccagtctctgttgtctacttttccactctctacctccatgtgttcaaattttttacctcctacatatacgtgagaacatctgatttttgtatttttgtgtttggcttatttcatgtaagataatgatctccacttccatccatgtagctgcaaatgacataatttcattgtttttatggatgaattgtattccattgtgtagaagcaggcagaattgactctgatagtagtctagctggaagagaggctatagctacaaagaatcttgacttaccaaaacactagtaacatgtctgtgaaactgctgtagtctaactcatttactactatgttaatttggagcgtgaagttcatcagtggaatgggtactataatttgcgaagttcaagtgacaattctggtagataaagtttcaaggagcagatggtcacaactgtcagtctcagaagtaatttggtaagtaaaatagtcatttatttggaagttttttggtaacctaattgtgatctaattgtcaccagttgggagtctaattccattttcatcactcatctgcagaaaggtgagagaaataagctattaattaatagccaatatttacgagctcttactatccaccataaagtatgctaagtgctttatgtgcattatacttaattatagtaactttctgaggtagttactattattatttccagctagttagtggaagaaccaggatttgaatccaggcaaactgactgcagagccctcacttttaacactacacataaaactgagtttatttaacagaaaacactgtcctttaacctgagattgtgtctacctttcaatactaaaatgtactttttatatgaaatggtggtgatagatgatgtcaggtttgattttcttttttttttttttttttaagaaatctttaccttgcaaaactaaaactaaaacaacccaatgacagcactgctctccagtttaaagaaaacaaacgttcttttgctagttgtgaaatctaaatttgagaaccactgactagaaaagtgggactcttagtaatttttaaagttctttagagatttttcacctgatttattttctgatttcaacctccttgttttcattaaccttttccttaagtccacctcagccactcattcttcgattatacacaagactttgtttgccattaccagcaaccacaccactttggggatctcagatgtaagcatcttgctctcgcgctgcctcccatttttccttgcttactcctagcatttctcctgttaccaactccagcaacttggaccccactggaacctccagtataatttattctatcagttcccaatctttttgttctctctctcctctttccccagcttaacctccatggtctatcacatatatcctctttgtatacacccttagcagccttgctcctcatcttctgttgtcaaatccacaagtgtttctcagctacctgcctactctgtgccagtattctcgctgttaagcatggcttaagaaaaacacaaaaccacagtgtctgatctcactttaaatttatgaaccaaatctcaagtgagccctcagtatttcttggaacagatattcctagtattccttctgtatttccctagtccaatccatttattctcctattctctgagatgactagttcttcttctctatttggctcaacccccaagcaccacctcttccatctttaccagcagctgatgacctggaatctttacttcacggaggaaatagaggcaaacagaagagaacttcttcatcttcttcatcttcccaccacaagatgtatgattggttgaatgagagaaagactgtgatgtcctagaacttcagttgctcctatatccaatgtaattagcaacttaaattccaaaaccatatataaaaatcgatttttggccatttgagattatactctttactaccactttcctttctcttattataaccaagagttgttactatgtttgtgcctcatccaaataaaaagtaggtattttttagaaaatgattaacgggagcaattagtaaaacaagcagtaaaatacccggatacaggaaattgagccaggcttgctggtatgtgcttgtcccagctactcgggaggctgagttggaaggatcgcttgagcccaggagttccaggttatagtgagctgtgtcacaccactgaactctggcctgagtgacagagtgaaaccctgtttctaaaaaagtacttgacataggatattgagagaagaaatgctttggaactatgtttgattatacccttagcccaccttagttcttacttaagtaagttatagatgaaggagaaaagatgggaatcactttgaagattaaggcctcaaactttgtggaaaatggaggaaaaaatgttgaaaacagtcatgtgatagtttttaccttacacttttgatgggaaaattagataatagaattgagctatacgtatgttgactgcacattacattaatttaatcctgttatttacctcatattgctaacctttaaaattaagatttgaaaaaaaagagatgggtaaaaccaaaaaggtcaaaatttgtatgccagcttagatgaaatttgtatttatagaactgaataagaatctacaccttacctaatactgtgaattgcttatgtaaatacaacaaaggatggtccctcgatgacctgaatctcatatgctgagttcacttagtaacagcgtccgtctgctcagacacattttcccaactccccatgtgctttccaaacctttaccatgtttcccagtatcctctcttcatccctcattttgttgatgacctagttcctgcttcacatagtcaacagaacccaacaggaataacctcagctttcttcctccttgtccctttatttaactggtctcagaaggagaggtgtctttacaagctctccctctccattcctcctctgttgccaaagttcctgaaagtgtggtctccatatctgcttatgctacttagttttcttctaagtgaaaggtagggactcaaccccaaatgctctgaccctgttcgaagaccctgtggcctagagcggcatgtatttcctgatttctaaacctagtgccctttttccaggcctcatcctctatcactgcagcatttatctctgttgtcacattcttctgcttaaaacttttcacagcttttcacgtacccagggcaggcattcaaaaatattgaagcagtagttttgatgtcttttctgagctttcaccagtatttttaataggcactactgcctaaatgtcaaatgccttatagccaaaaacaagtaatgatttcctgtaatctccaaactgattcctcttcctcttgctatgtcttggtatccctgaggttaccatcattttatccatgtacccatgctagatgcctcaaggtcatccttgactcctcttccttctctggtttccatttggtttctaagctttgatgagtatctcccgcatcttcttttctttttctactatttcctatgactcttgcctctttctgtttattgtcttttgtctggattatttcagtaatatgttcaggagtttctaatttggattccatggatggacctcaaaggattaaagaactctctcaaatttgtatgcaaattttttgtgcatgtgcattttcctggggaggtccattagactgttctgtgggaaagagaggaatagaatgagagacaatgacaatttaaatcaggtccactgatttctcgttctatacctggcctttgttatttaggtcactaacctaaggcacttatctctgaggagtgaggtggcatgtaagatattaagaataaaacagcagcattagtcagtccagctgggcagtcagtccagcagccagagatcagaggctcctcaatatcagatccaggctttaatatcctagagaagctcaggagaaagctggggcatcagcaggagcagagggtgtcctcccgaggcccctggacccatttgttcctgtgcttccaaaggacttagagggatatgaaaacttaactggcaagaatccagagtgagttggtatccccagaaaaaggttcagaacattcccccagctagcctcccctcctttgcctgtttggtctctcgttctttctccactctgccaacacagttagcttttaaatacatatctcctggtgtgccttccgtgattgtcacttacacctaagggtgattagactaatcacccaaaaatgtggggttttaatcacctatgaaacaagttaaaaaatcatggtcatggtttcaaggcctgccagttaggagcctgccagtctcgtcgccaggcactgccctctcctcacttccagggctctggctacagcaggttactactggctgtttcgagagaacagtgtctgtgtccatatccctatgcctttgatcatgctagtctctctctttggggtggcatttcctctccattgcctgtgaacctcctactcattcttccaggcccacaatggatgttagctcttcacctgagtccattcttaattttctgccatcactctggcagaatcagtatctcttggctagagtccaaaaacatttcatacatatctctgataatgtcatattatattgtagatagcctatttttatttctgtctttcctactaagccagaaatgccctacagctagggactgtctttttcatgtttgtatccctaacagctacctttgcatctagtctaaacatgagcttagtacacttttgttgaatggaattagttataaagagtttttatgactcatttaaaattagagaccaatgcttacttaataagtcagaataggctgtaataataatagtaataataaagtcccatttccactgcttattcaagtaacagcttcctttgtggaagtacattttgaaagacttcacatgtcagtgtatatttttgatgtgctcatttgagatcctaaaagaattatagttctaaagcagactagagcttctattacattcctgttgaagttatattaaatatattctatcgtttcacatatctgtattatatataataagttgcatgggtaaacattttatctcttttaaacttcatggtaataatttgtgaattgtttattttataatatctgagtaaatttagttcaaaacacattaatttgagcattttctgtgtacagaagcatagttgcaaagttaagattcttgtgtttatgttgttttgttaaattcggaaagtctcagtcttgcaaatgtattttttttttaagtatttaaattagctcagctatgagaataagcacggtccataaattaagagcttcaaataattttttaaaatccttcatattctttgagttttgtaggaaaagaatcaacagtttacttattcagcctttcctgaagtccatagtaggtgctgggcatcatgctgggtgaatgagatagtacttgcatttgaatagtttacagtcttatagcgaagaagccatgtaaacagagaattgcaatataaaccttggaggagaggaaggaagactactttgagaaccgagattaggttgagaatggatgagtctgctgatcaatttatagataaagaagcagagaggtgaagtctttttttttttttttttttgatatgtgaaataggaacctaggttatctctaagaattcatagcagggggtagctcttgagaagaacagtgaagatctggataattaataaggagaattagagatgagctaacaaagacaagtaaagagtggcatgagaaagcagtgagcatagaactgaaactggatagcatgaaattctggaggtatcagtcagtagcacagtggtataattttctccagctgtgctatggagaaattatacacattgtggccaatgtgtagtgaataaagccatattgtattcagggactatggggtggttataacagaaatttacaaagaataaatagttaaaagtccttcaaagaaagcatggcttactagggaaggcagtatggttaagaggaagttgataaacttggagaaaatgtagaagtcaagaagttggagatcagaagggctggtgctttgtaggaactcagaaaatcttcattttcttctttctggatgtcctctccctatgaatgtttcaccaccaccacctgcctcagctacagtttatacatatgaatagtttcaaatcatgatggtaacagttggctcagagggcaagattaggagccagacttcaacgtgctgctaatccagcgtgtccctgtaacttagatgctggtagtgcttggtggtattggcctctaggagaagctcaaggcttctcctgttatctccctaccactcatacttggagggtgagtcaaaggccaaaaagcattttattgggcagtggttcttagggaagggatttactctgtgatgcagagggttaagactgtaagccatcaagtgtttcccctccctctccatgttcaaccaaaggcacagttcttattactttcaaggatttaaaaaggagtcttttctcagcataaaggaggaagtgaagaccaattttgacagcccaaagggtcttcctcctcagaatctaaaatttctaatagagttgtttgcatcttgtgattttacttgagtcatcaaatgtattgtactttttttcttaaagatatacttcttaatgctttcatttcagataaggacaaaccattttccatggcgacacactatttatattgcattttcagaaatttccctttttacccatacttaggagtgtgacactgaaacctgataatctattatttcacagagtgcttttttgggtgtaatataaagatattatataattttaataacctttgaggtacaagtggtttttggttacatggatgaattatatagtagtgaagtctgagattttagtgcaggacccattgtccaagtagtgtaaactgtacccaatattagttttttattcctcactcccctctcactttccccacttcttaattttctgccatcacaatgtgttgcccaggctggtttcatgccctcactttccccacttctgagtttccaaagtctattactctgtacacctttgtgtacccataacttacctccctcttgtaagtgaaaacatatggtatttgattttccattcttgagttacttcacttagaaaaatggcctccagctccatccatgttgtagcaaaagatgtgacttcgttctttgttatggctgaatagtattccatgggatatgtgtgtgtgtgtgtgtgtgtgtgtgtgtgtgtgtgtgtgtgtatacacatatatgatatataataattatatataatttatcgttatatgtaaaacaaagcaaattttttatttttatagagacagggtcacaaagtattgcccaggctggtttcatgctcctgggctcaagtgagccaccacacccagccaaaaataagtaatatttcccagttagacattttcagagtaaaaagtatttgttcaaaatcatagcatgaatggactcttccagagacctttaactggcagcatttccccctcaaactttagtacagttataggaattgtttctggatttttggctgtatattcttgttcatggctcatggacattaacatatgtgaatggcatcactgtgtttttcctaaagtgcatacgaagaagaaagaacactttcctttagagtcttacttagattctagttagctgatataagactgttttcttttccttttcaggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggagggtaatgtgaacataagtgtgatttagtaaaagtttatcactcgctatacgatgaatgagacccagagttatggagacaaacttgttgctttgatttatattttgaagcaacttacaggtaaatttacctagtacctaggttatatatggcactgcaccagggactgtggaagatttacgtgatgagcagatgttgttgcccacatattcctataaacaaaggtaggtgattgtgtaagccagaggttttgcaaaaataggtcatgaatatattttcaggtgacacttttattccatattgcttccagagacttgtgctcatttatcctttggaagaaaaggggaaattaaatccataaatagacttatgaaatcgtattatgtaaggttcatatgcaaaaagctatcttacttaacactgagtcttgctcagttatagagtgacaggattgagttgtcagagctcaaaggaaagcttgatttgcgtctcagaaatgaaattatttaaaaatcaagctagaatttactaattctgatagttttacatgtcaacttgactaggacataaagtgcctaaatatttggtaaaacatttcggttgtgtctgtgaggatgtttctggatgaaattagcgtttgagttgatagactgaataaagcagattgccctccctaatgtgggcaggccccattcaatcagtttaaggcctgaacagaacaaaaaggcttactttcctgcaagtaagagggaatttcgacttgcctggttgccctgagttgggacattggtttggatgcacaccgaaacatcagctcttcctggcttggaggcctttgggctggaactaaataatgcgtattagctctcctgggtcaccaggttgctgacagcagatcttgggacttgtcagcctctgaaattgtagatttatcccaaggaattggctaaaacgattatggaggctgacatatatatgtgggtgtatatgcatacatacatattcatagagatttatcataaggaaaacacacacacacacacacacacacacacgaacattctattggttctgtttgtctgttctgattaattatcctaatactaacatatttttttcattgacagtttaagaacaatgccatgagatttctggttctagcaatacagtagactaggtaaccagaaaaccttccttctataaacaccttcaaatgctaggtatacactgtaccccttaaatatgcacagttatgtgccaattaaacacaaaataaaacttttaaaagttctgggtaaaacataactgaaatcattttaaatgcataattgagctcttcagaaagaaaactggatctccaggaaattagagtcgtaagatacgggctgcagcttttggtttcataatatatgggtttgggttttagtacccactagggaacagaacatgagtccttgaatccatttacagtgtggactaggaactggtaccttcaaaggggttgtgtctatgaaaagagtggactagaaaatatctgctgctaccacagggaaattaacaaaaaatatttaactgcctgggttctggaatggaagctgggaaatctcctatgggaattcttcttcttctttttttttttttttttttttttttttgagatggagttttgctcttgttgcccaggctggagtgcaatggcgtgatctcggctcaccacaacctccgcctcccaggttcaagcaattctcctgcctcagcctccccagtagctgggattacaggcatgcaccaccacgcccagctaattttgtatttttactagagatggagtttctccatgttggtcaggctggtctcgagctcccaacctcaggtgatctgcccgccttggcctcccaaagtgctgagattataggcgtgacccaccgtgcccggcctcccatgggaattgtaaaccatggatccttgttcatgctggtttagaatttgaatgaatgtatgctacctatgtggcttgaaacccgaagctgagaaattagttaaaaaaattattcaggtgcagtggctcatgcctgtagtctcagctacttggaaggctgagatggaagggtcactagaacccaggagttctaggctgcagtgagctctcattgtgccattgcactccaacctgggtgacagtgcaagaccctatgttaaggaagaaaaaaattagtcctgggctagtgatagcataagttgtcagatataagcaaaccccagggggtgctccaacaacctaggctgaaaggaatagaaaaagtagtcatgaaaatttaaaactcagcaaccaagtttaagataagacaacaaatttcagctgaagagagaagtggtaaacagaagaataaacctaaagaaatcacccagaatgtagcacagagagataaagggatggagaagatgaaagttgagatgagagagttaaaacaagaagtccagatagaatagtgtagaggcattattcaaaaagagaatgactaagaatattctagaattaataaagacataagtactcagattcaggtagcaccatgagcctatatgggataaatgaaaattaacttatttctagacttgttataggagaatgccaaagaaaaaaaatcttagtaacaaaagaaagacatggagatgacttacaaaggggtatccattatgttgatagcaaacttttccatgacagaaagagagaacaaaaaacagtagaataatatcttcagagagctaagtgaaaataactgtcaacttaaaagttaatacccagcttaattctcattcaggaatgagggtgaaataaagactttttttcttcaggcaaaggataatagaattaactagttgcagaagcttgttggaagattatgaagcaagatgtactgagactgaaggaagttgaacccagaaggaaacagtagagccaagaaacaatgatgagcaatgaaattggtgaaaatatagataaagtctgggagttctacttctagtagtggcaaattaggtcatttgagtcatgtgttccactgaagactaccagaaaagctcaacacaatatttaaacatgttttgcttgaaggtatcaaagaagaaaaatggaggcctagaacaaaggtcctcctggtatactgggtcactgttcctctcgagatattagccagttctgcaggaagctgctaaaacctaagcagcccttttgacaggctagtgggagtaatgggggcagagattagtgcccatggcccctaaggaggggacacctgatgaacataactcattttgagtcaagaccctgaagggctacaccataggagcaagggttaaccaggagtagacatactctcactggggctgcagatcagctttgaatcatgtcagtccctaaaattagattgagggttcctaaattgctagtgcccctaggcatctggcagaattgtaaatccttcctggaagaaagtggtatcatgtaaggtcacaaattgtttctagtttgcaaatgcaatgtctggcttataatcaaaagcaactggaaacagatacacaaacaacatcaagaaaaagaaaagatggttcaaacagcctctagatattggaattctcagatacagacttttgaaataattatacttaccacattcaaggggataaaagacaagacagatttttggcagagaactggaaactaaaaataaacaaatataaattctagaactgagaaaatcagtaagtaaaattaactcaagtgaatgagtttaaatagcaggttagacacatctgaagagagaattagtgtactgaaagatataagatgaaaataaccagagacaaagaatgaaaggaattaagagagagtaagagagagagagagagaataccgtttaaaggtctggtgcgtgtatttaaagttccagaaaggcaagagaaagaggatgaatcaaaatcaggatttgaagagaaaatggtttagaactttctaaaactgatggaaaacattagtccataaattgcagaaatgatatgaaccctgagcaggagaaataccaaagaactctacatatataggcattattgttaaattgctgaaaaccaaaaatgagaaaaatcttaaaaggagctagagagcaaaggaaaattaccttcaaataagcaacaactagctagtagctgtcttctcaatagaaatgatggaaacaaaaagtcaatcaaaggccatttttaaagagctgaaagaaaataactgtcaacttagaattttatatccagtaaatggatgaatgatcatagaaatatataatggaatacaaggcagtaatgaaaataaatagcctacagctatatacagttgtgaatctcacaaataaattattgagcaaaagaaaccagatttcaaaaagaacacatactgtgtgattccatttatagagagcttacctaaagtatagtgtttaacaacacatgcttgggtggtaaaactataaaggaaaatgaattattaccataaaaatcagattgtggttacctatggggaaaggtcagggaggagtgcttgggaggggttgtgaggaggtgctcccaggatgctagcagtattctgtttcttatgattacgtaggcgttcattttgtgacagttcattgaggcatatattcacattttgtaacttttctctatgtgtgatgtattttgcaattaaaagttttaaaaataaattttaatagcattcactgagaaaaacaataatgatatgaatatttttaaaggatagaactaaaatatggaaaaaaacgtttgggaagtagattaaattcatgtaagctccttatattattggggaagatggtagggagtttgagaccagcctggtcaacatggtgtaaccccatctctactaaaaaaatacaaaaattagttgggcttggtggcgcacagctgtaatcccagctactcaggaggctgaggcaggagaattgcttgaacccgggaggcggagattgcagtgagccaagatcgtgccactggattccagcctgggtaacaaaagtgaaactccatgtcaaaaaaaaaaaaagaagccaataatgttagttaacattaagtcaaatgtgcatgtgaaagttgtacattgtgcccaaacttttccaaagcatagggaggagctgggaaagaaacaatggaaactcaaatactttagaaggcaagaaagaaataacaagactcaaagacaatgtgatgataataaaaaggtaattttaaaaacaatttcatttatagcagaaatcagaatgtaaagtgcctaggattcgatctagcaggaaatgtgcaagacctttaaggagaaaattctaaacatttttgaaaatctttttttaagcagctaataaatggtaagatataacatgttcatgtatgggagaactgacaatgtcataaaaatgagttctgcccatcttggtctgtaagttgagtgtatttccagtgaagcctaataggaattttttaacatttgacaacttgattctaattttttttgaggcttgaagagttatgagaattttgaagaataatgaagatttacttttatcacatatcaagacttactagaaagcaatagtaattgaaacaatgttatatattcatgtaaaaacagaccaaggaaacaatagaacacaggaaggaagagcctgctctatgacaagtgatgatacagatcagaggggagtaataggctggctgtgccttaaacggagctgagataattgactacctatttggaaaaagataaaatgcaattcctacctcacagcatacaaaattgcaaatggatttacaaaaaaacaaaaacataaaagcctactaaaatttataggaggaaaacttatttagaagaaaaataggcaaaaatgttttaagatttgaggctagggaagaattgatacagaaagtaaatccattggaagtgttaatttggctacattaatataaagaaaattctgtatgacaaattacactgaatacaaatgtctcaaactgggagaagatatttgcagtgtatataatctacaaagaattggcatcctctataataaattctctataaaaagtcttgtataataagaaaaatataaataccacaatttaaaaaaactgtcgaaggatttaacacgtagttctcagagaaagaacacaattgaagaaaagcaaatgaaaagatattcaggaaaatgtataataaaagagggattatttcttaaacaacctggcaaaatttacaacagctggtaaaaccaagagtttgtggggttatggagaaacaaggtctcatatacattgctagttggagtataaactagaagaatataccaagtgggtagtatcttgcaaataaatttgacatcttacaaaaatgaaaatgcacaaaccccatgagttctacttcaagaccactacctatgataaacaacatgacatgtaccaggatgttgattgtcatgctatttgtaatagagggaaaagaaacatcattactcttccttagtaggaaatggaataacatacagatattaaaatgaatatgctgagcacagtggcccacgcctgtaatcccagcacttcaggatgccaaggcagaggatcatttgagcccaggagttgaagaccatcatgggcaacatagtgagaccccacctctacaaaaattaaaaattagccaggcatggtggcacattcctgtggtcccagccacttaggaggctgaggtgggatggtcacttgtgccggggaggtcaaggctgcagtgagctgtgatagtgccactgcactcccgcttgggcaacagaatgagaccctgtctcaaaaaaataaaatgaataatagatttacatagatcgacatgaataacactcagaaatataacatcccgtcttcaaaaaaaaaaaaaaacctagtaagctgtactgaattaatctatcctaccatttaaaatttttgttgagggtaaaataatattaaatattccctttatagcaatcctcttagtgctttaagtctgcttgttgggtccttaattgtttcaattttatacaaggtcgtttcctttcctgctttccagcatttcattaagttcttgttcaggtctccagctagatcagtctcattggttctagcaggtgtgggtcttggtgggttggtgcaagtccattcactatttcaactcttcagaaagtcccggaaccagtcagttttgcagttcattcctaatactaagattgtttctgcttcacttatctttttaacttacctcagtgtaccaagaaaaacagtcatcaccatatactatctaggttgaataaactccgcttaaaaattattttagattattttccaaataatttacaaaatacaagaataaagagataaaaaactattaaaaattaaataagaacttaaatatataaataaaatttttatgccatgtttccctggtcttgaggtgttttggattttggtttttggaatatttgcatatacattaagatatcttggcgttgggactctggtctaaacatgaaatccatttatgttttgtatataccttgtacacacagcctgaaggtaatcctgtacaatattttaaataattttgttactgaaacaaagtctgtgtacattgaaccatcagaaagctaaggcatcactatctcagccactagatgtggatggtctgtggttggttggcatcaccattgtttctgagtgtaaatttatatgcctgataaataatcgttttcatacatgtattgagacacaagtacttaacagtaaaaaatatgacacaccattaatacagtgaaaaaatagtgagtttagggtaactaagcagcacaatggcatcaccagaatacctggataagctgttaaacaacagcaacaccaaacagcaacagtttcagtcaccacctacgatgttgtggggggcttttgttttggtttggttttttgagatggggtctcactccatcgcctaggctggcatgcagtggcaccatcatggctcaccgcagcctcaaactcctgggctcaagccgtcctcctacctcagcctcccgagtagctgggactacaggtgtgcaccaccatacctggctaattttaaaaatctttttgtagagacaaggtctccctaggttgcccaggctggtctcaaactcctgggctcaagcgatcctcctgcctgagcctcccaaagtgctgaaatgacaggtgtgagctaccatgcccagctgatgttgtgttttgattaaaagattatcatacagtaaccccctgtgtgtggtgcacctttcagattttggaacattttggattttgaatttttggattagggatactcaacctgtataccccaaatgggcaggagcctctgaatgcagtaactgttcatcagctgtcctgcatgaacttacaaatactgattctaagtttcaaatacatctttgttggcttctaaattattattacttctggttcttcttgcacttacagcatcaaaacataatgctttaagaatttttttgagatctttggctcctaattttgttgaagagaggatgaccattatatgttccacagttgcaaaacatttttatttttagatttgtagatacctttcagaatgatcaattctgttttttatggtcaatccaattttttaatgtctacttcatctatttcttctggctatctctctgtaatacctgccttcagcatctgtctacttttaaactatatcaagaaaatttggtgcacaaatgaaataaaagatgaaagaatactgtcatgtgtccttttagcaaaatgggatggcctcatttcttgtcacaagatattccacaaagaagactttctattgaataagtaactgaatgaaaatgctttgtccttagattaaaagtatattattcactcattgattcttgagtttgagaaaatgtatgtagggcatcatcatctgaagacacatagactgagattttacttataatcatcaatttcagcatctttattagagtcctaagtgctcctatcttattctttgtgttcaacttctgactcatctaataattctaaaacagtttcctcagattttcttcgtcattctggctagagaacttacaaatgttaatgcttaatcgtattcaataaaatgtagaatgaggtcacaaaagatgttagctccagacttcttttatgccttcttgaaagataacacatatcttgcacaacacagtaagaaaactgaagagtgatgtcatagtgatacttgtttcactgtttctaagtaatttagtcattttttattatactttaagttctgggatacatgtgcagaacttgcaggtttgttacataggtatacacatgccatggtgactggctgcacccatcaacccgtcatctacattaggtatttctcctaatgctatccctcccctagcccccccacccactgacaggccccagtgtatgatgttcccctccctgtgaccatgtgttctcattgttcatttcccacttatgagtgagaacatgtggtgtttggttttctggtcctgtgttggtttgctgagaatgatggtttccagcttcatccatgtccctgccaaggacatgaactcatctgtttttatggctgcatggtattccatgtgccacgttttctttatctagtctatcgttgatgggcatttgggttggttccaagtctttgctattgtgaacagtgcctcaataaacatgtgtgcatgtgtctttatagtagaatgattgtaatgggattgctgggtcaaatggtatttctggttctggatccttcaggaatcaccacactgttgaaacagcatggtactggtaccaaaacagatatatagaccaaaggaacagaacagaggcctcagaaataatgccacacatctacaactatctgatctttgacaaacctgacaaaaacaagcaatggggaaaggattccctatttaataaatggtgttgggaaaactggctagccatatgcagaaaattatacaaaaattaactcaagatggtttaaagatttaaatgtaagacctaaaaccgtaaaaatcctaaaaaaaaccgtaggcaatacctttcaggacataggcatgggcaaagacttcattcttctattttcttattttaatcctttttaagcatagttgagaataattgatgagtaatgatgtaatttctagtgtgatgaaatagcataatgtgtcttagattcataaaaagatctagtagatccaaatggcaattgtaagatagaattttattctatttttttaaatattgggttttttgttttgtttgtttgctctttggaaaaaggaaaaaagtcatgagatatcaatttttataaatagtactacttaaaacagaaactcagaaactgagattgggtctaacggaccctaatgagatactgaggattaaacactaggcagaagtgagttaaaatgccatatggagaagcattttataacatctcagttgtgatagttaccacatggctacataggtaactttggtgctgtttttaaagttgcaagcaatttaaatattaaactactgatgataaaattgagttagcaaagaatttccagttcgatattaattatagccagccttttcagttatacctttctcacatccagaaatggcttgatgtactcagctaatgacctcatgcaggatatatatgtgtgttacatgataaagaaaaacatcacttctgtaattttggacagtccacactgacggagatgaacacttgcatataggtcaaactagttaaatacagaacagccgcttttgaaagctgttgccagggctcaacagcgtcagctctgtttctatggagaaagactttgcagatgttaaaaacagagctagaagccaatgaatggaagaggattgtgctgtggaaatttaatttttttgataaagggtttattgatgaatcagctatattagtctgtgaacgttaatcttgacatcttctttacccaattcccaatttcttggaataagatcttgcttttatttaagtaacacacaatgtaaaatttgatgttattgtactgactaggtggggtaagggacctgatgacaggtaacaagattagtaaggttctgaaaaggtcagaattgtactgaattatgtttagaacagattgcctccatgatcatttaatcaaacagtgttcgtattgtctttgtccttgtccacatacgtgatttttgaggttgggctgagaaggaaatcatgattccatcaacaacataaggcacattgacagtaaaactcatatattatagcagctttttgtttcatgctgtatagggcagacaaccttgaagaaaaaaaaaactttaaaaaataatgtaaaatttcacagtttttcagtcacaaacagaagtatccttgttgtcactgaagatgacaagaattaatatcctgctgtatagaagtactttggcaaagttaaggttgtagttccaattcctcatttccaattttttctccagatggaaagatgaacagtttttggtattgaatttttttttaggaagcaagttatttatcattagatatctattcagtaaatgcaatgatacagaaaaatgaagtttttttccctcagatttgaaattaggttttaaaatatggagggagaacaatttgtaagtaatgttcaggaacaaaaataaaacctaatgaaactttagaaactttgatggacatctgtcatcctacatacaattgcattaaagaatagaatttattattattttatctggtttattatgctgtaaaatgaatttttctctttttgtatgtagttttatgaaatttcatacatgtatagattcatggaaccactgtaaaaatcaggatgtagaacatttgcatcacccccaaaaactccttcatgcagtcccttactggtcaccctttctttttagtaaccctggtaactaccaatgtgttctccatccctgtagttttatcttttcaagaatgtcatataaatggcgtcatacactatgtaacctttggggactggctgtcttcagcataatgcctttgagattcatccaagttgttgcatgtgtcaaacatccctttttattgttgaatagtatttaattgtgtgggtgtactatcatttgtttatctcttgacccactgaaggccaattgggttgttttctagtttggggcaattatgagcagagctgctataaaccaagtagtggaatttttaggtcatatagcattttatctattttttatttaaaaatatatattcagggtttgtttttgacccagttgaatttccttcaggtcatttttggaactctttcttcctatgtctgatgtaacatttcatctttcatctttgtcatttttttattcccccttttcttcagattactataggtatattctggtattgtagcccagaatctgtcctgcttttatattcctccagcttaattatatgatccatcttcttacggtatctacggcttgctacaagactattctttactatttgcagaagacgttcagatgtatcttgctatccttttttattcagttgtgtatatcttgttctctatttggaggcctttccaaatagatgtcttgttaactctttaatcttatcatgctagaaacaaacaaacaaaaaaaattcccttgtatcttttcccttctgcagcttccttatcatactacagggtaatttcttttcttcactgtcagtcttccaccctacatgcaagcaataatcaaatctagcatttgctgtttggtcatcaccactcctgtcaccaaaattctcattctgtttagattctgcttgcctcatttatgtaccattatttgtttctcactgaccttccaagtgcatacttcttttcatcctaaagccaagaataaaatcattttatataaagagcattctactttgcagttcatttactgatgtcctctgtttcagtaggaaggcctaattctagatttcagtctgtcatgatagtactataacttctgcttctcacattaggtaaattttattatcccttttataggaccttgactgcctctgggccttctgttcagttgaacccacatgcttctaacttcttagctattagaccctctctttccccttttatatgtctttgttttggtacagcttctcatacccaaaagcaggtatacctgttagtaaggaggatacaagttgtatttgtaggtggtatgattgtctacctaggaaattcaaaagagtcagatttttttaaaaacttagatattataaataagagtaaagtagccatatataaaataaatacataaaaatatatttccttcatacttctatactgtttctgaaatataatagaaaaatcccatcacaattgccaccaaaaaacatagctaggaatctttatgaaggaatgaaggaatttaaacaacaaaaactataaaactttattgggaagctgggcccaatggctcatgcctgtaatcctagcactttgggaagccaaggtgggaggatcacttaagtctaggagttgaagaccagcctgggcaacatagtgagaccttatctctaaaaataaaaataaaaataaattttaaaactttactgagagacgtaaaagtgttgaataattggagaggcattattcttctaaaaaaccaaatatgctatacagattttagtatttcctaaacttagatatttaacctaatttcagtcagagcttgggtttttgtctgttctttatttttttatttttaattggtggaggttattccccctcataagaatgattctgatgttcatttggaaatacacatggttggaaatagccaagatagttatgaaaaagaagaatgtatagaggagaagagcttcttcaatgtactactgtaaagttatggagataaaaacatgaatgaatccattgagcagagtagacaggctggtaataacctagcatacatcaaagtccaaaccttggtatgatggcagctcagtcaacgaagaaaggagggataatttagggaacaatgctgggtcggttatttgaagaagaattagttggcttctcactttacttgtaccatacacaaaaataaaacaccagataaagaattatatgtaaagcaaaaatttaagaaaagaaaatatgtgaccatcagtgtctgtaatggggaacaattttaaggataaaactaatgaaaataccataaaaataaaaattgtgctggctgtttagtagaaacagaaaacgccttccacttaccgaaaatataccataaataggctgggcacagtggctctcgcctgtaatctcagcactttgggaggccgaggtgggcaaatacctgaggtctggagtttgagaccagcctggccaacgtggtgaaaccctgtctctactaaaaatacaaaattagccagacttgatggtgcacgtctgtaatcccagatgtgagaggctgaggcacgagaatcgcttgaacctgggaggcggaggttgcatgagcagagatcataccactgcactccagcctgaacgacagagcgaaagtccatctcaaaaaaatatatatacttatatatatgcacacatgccataaagaaaagacaactggcaaactagaataaagtagttacaagtataataatggccctaatgtataaatcattttttaatcaataggaaaagctcttgaatttcaacagaaaagggtatagaagacatatcaaatactaataaaattaccaatggtaaaaacatgattttttaacagcaccagccccttcagtaattagataaatgtgatttaaaaacaacagaaagatactattgtccatctatcaaattgagaattacttttaaagtgtttctaatattcattacttgtgggaatataccaagataggcactatcaggtactgtgctgggattatagattgataaaacctttctggaaaagtgtttctactttttcaagtgttcctatttcaagggccttaaaatacttaacacaccttttaacctaacaatttgcctttagcaagtattcatctatattgtcaagcgtttaagtataaaaatgttcattgtaggctgggtacagtggctcacatttgtaatcgcagcactttgggaggttgaggcaggaggatcacttgagtcctggagttcaagaccagcctgagcaacatggcaaaaccccatctctacaaaaaaaaataaaatattttccaggcgtggtagcacgcatctgtagtcccagccactcgggaggctgaggtgggggattgcttgagcccaggagtttgaggctgcagtgagctttgatcgcaccactgcactccagcctgggcaacagagtgagatcctgtctctacaaagaatgaaaaaagaaaatgtttattgcagcaacatatataatactaaaaacttagaaataattaaatatctaacagtaaggaatgaatatggagtaggagagttaaactgtgaaaccattcatatgattaaatattatagagctattaaaaatcatatcatcggccaggcgcggtggctcactcctgtaatcccagcactttgggagggcaaggcaggcggatcacaaggtcaggagatcgagaccatcctggctaacacggtgaaacccatctctactaaaaaaaaaatacaaaaaaaaaattagccgggcatggtggtgggcgcctgtagtcccagctactcgggagtctgaggcaggagaatggcgtgaacccgggaggcggagcttgcagtgagccaagatcacgccactgcactccagcctgggcaacagagtgagactccgtctcaaaaaaaaaaaatatatatatatatatattgtatagggatgggaaagggtttaaaataatacctgtactgaaaaacaggatgcaaggtattacatagctccattttggctgagtttgagatgattgtgatttctttattttttgctattttcccacattttttataattatatattttgcaattggaagcaaaaataaccattgaaaatcgttttcaaagaataatattcaagagaatacaaggtgcagtaagttcttaatatttagttaaaatatagaaatctgtggaccattaacagcacttatctttaggtaatgtaatgatgttttatagatgggtctttattgatgggatgtcactatgttgcccaggctggtcttgaactcctggcctgaagcagtcttcccacctctgctttccaagtagctgggattacaggcacaagccatggcaaatgtagtatattttaatttatgtttttagtgatggaatctcactgtgttgcccaggctggactccagctcctgggctcaaggattcctccagcctcagcctccagagtagctgggactataggcacgtaccactctgcccagctttatttttacactttatttgttttacaacttttgctctgttaacaaatctactactcctttaaaaagttaaaaaacattctcttattaaaacaaagattaggctgggcatggtggctcacgcctgtaatcccagcactttgggaggctgcgctgagtgaatcacctgaggtcaggagttcgagaccagcctggcaaacatggtgaaaccccgtctctactaaaaatacaaaaattagccaggagtggtagcacatgcctacaatcccagctactcaggaagctgagacaggagaatcacttgaacccgggaggcagaggttgcagtgagctaagattgcgtcattgcactccagcctgggcagcagagcaagacttcatctcaaacaaacaaacaaaacaacgattatatccttatcagagatttaatggatactaaccatatttaatcctcagtctcattatgctcatttaatttttattatccgtatgttgtcatatttaggttatgttcattttttaccagttttgttaatccctagtgttttttgtttttgagacggagtctcactctgtcgcccaggctggagtgcagtggtgcagtctcggctcactgcaacctctgcctcctgggttcaggtgattttcctgcctcagcctccagagtagctgggattacaggcacctgccaccacacccagctaacttttgtatttttagtagagatagggtttcaccatgttggccaggctggtctcgaactcctgacctaagttgatccatcctcctctgcctcccaaagtgctgggattacaggcaggagccaccgcacccggccgtgttttttgtttataaaagaaaaaatttccagagtgcactttactccctgataggagactaaattacttaaatataaattttagaaggtacgtgttaaattaacctaatgaattagtagcattcagaagtgtttgtatctgttaaagattcaaaatatacaaactaatttcttttaatggtgattctatttctagtaaactaaggcagaaatcattatgcagaagaaacagcaccctgttaaccatgttctttttataaaccgtctctgttctcactttattgttaggaaggcgtaatctgttttcatgtaatataagtacatgtgagtcatgttgagtttcttcactcatttgtccaattcccagtcaacctgtaggtggagttaacctttagttacataatataacgaaacaaacattaaacctactgcttctgggacagtcttctcaccaaaattcagggaaaatgggagggtgttgccactgactgacttaatgaaagtatctgacaaatgtaaggtctttcaaatagtgagataagaaatgtatataaattatttgatcgactacttactttctatctatacacacacactatcagtatataatgtgtattttcattttatagctattaaatatgaggttctagaatgagttttcagtttgcagaattctgagaatctagttccaacacctttgagaggacaacaaccacaattgcacttgccatatttattagtcaaaatgaagcgaagtcaatctgttgaaagctttgttttgtttttctgattagtttgtttaataagacattcaaattatgatctttaatataatttcttcccctaatagcttggtgctaacagtggtttgcacatcatcatctttgatgaaattgatgccatctgcaagcagagagggagcatggctggtagcacgggagttcatgacactgttgtcaaccagttgctgtccaaaattgatggcatggagcagctaaacaacatcctagtcattggtatgtttactttttaaaaaagtactattcattcaaaaacgttagccataagttctgaattaagatgtgtgtaggttgtgattaaactgttttgccagtgtttccaaattagaatccagtgatattgaagaatctattgtaatgcctaggcttaataggaaaaataaaagatggatttcagtcacttgtaggtttaagcttatagctcacccacaggtgaaaaagatgtaggttgaagcttatagctcacccaaaaatgaaaaatacacatgaaacaatggaatgcagtggttttcaaactgggtcttgcaggccttcaggggtcctcagaggtgctttcagggtcagtgagggccagggagtgcgtttcagatcctacatcactattataacttcctcttttagctgttttatgtactgaggtgcttctgaagatgacttctggggaaaaaaaaaaaaaaacaccctgctgttttatgaagtctgaaaaccactggcctgtaaaaaagagaaggaactttggagtcagagagatcgtgtcacattgcccctctgtcactttgacagattatttaccctttgaatcttaaattttctttttaaatactggaagttttcataacatttatattccattggcttatacagtagtgaaatagtaaagcaaagtctccttagcttgttagggaaattactattcttacatatactaaaaggacatttgattttatttttgaactctgatcatttgttgttttgttttaacatctgtgttcaggaatgaccaatagaccagatctgatagatgaggctcttcttagacctggaagactggaagttaaaatggagataggtaaggagatctgtcactgattgggtgtgtggtggggggagtggaggcatttagagttcattaacaggaacaatgtcatatggtgtagtattttttagaaaaggtttatatcatgagaagtagatgtttacatgcttgagtacctataaggaaaacattaggatcataataatctcctctaggctgggcgcagtggctcacacctgtaatcccagcactttgggaggctgaggcaggtggatcacttgaggccagttgttcgagaccagcctggccaacatggtgaaaccccttctctactaaaaatacaaaaaacttagccgagtgtggtggtgtgcacctgtaatcccagctactcggaaggctgagataggagaatcgcctgaatccaggaggcagaggttgcagtgagctgagatcgtaccactgcactccagcctgggaaacagagcgagactctgtctcaaaataataataataataataatgataatctcctctgatggtgctttcgagactaggaaaatgcctattttatttttaatttcatcaggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggtcaggaaaatcagctaaacagattataaacattatgccagtattctttctctttcctttcaagcatatcaaggggtagggaaatgctgacttttggtggagaagagatggtaaaaggaataagaattaattgtcaactgctaaatcttcagagtagcaggaaggaagataatgtttgcatctgccctgtagtaaccactgactcatctaccttaggtcatcaccatctgacacagacacgtaaagtgaaaattttgaagaagtgtttttaaatctttgtattgtattaaaagttgtaatatggccaggcatggtggctcatgcctgtaatcccagcactttgggaggctgaggcgggcggatcacaaggtcaggagatcgagaccatcctggctaacacggtgaaaccccgtctccactaaaaatacaaaaaattagccgggcatggtggcgggcacctgtagtcccggctactcgggaggctgaggcaagagaatggtgtgaacccaggaggcagagcttgaagtgagctgagattgcgccactgcactccagcctgggtgacagagcgagattccgtctccaaaaaaaaaaaaaaaagttgtaatatgtcagaggaagtgggagtttccacgtactagaattttgggggctgctttattcagcaaatatattgaatagttgatgtgttcaagctattgggctggagacataaagataattgtgaactcttccctcaaggagttcagagtcaggaaaatggacatattttcaaattagtacaataatattgtagttaccatggtagaaatacgtactaggatacttttattttgataaagtgctcttgatcttccatctcttctctcctttaggttttagttaccacctgtagacagatttactgaacatatctgtctcctactttcagatttgtactaaataccctcacctagatgttttatcaggtctcagatttaatattgcaaaaccaaatttattgtcttttttactactttcctttctgctcgcatttccctgtttatcccaatttcccaggcttaaaacatcaggattatctttgattcctgacactctactgtgccctaggtcaagtcacttgccaaattttttcagttctgtcttggcagtgccttttagttctcactgccactacccaccttctctttgattaaccttcctgtatcatatcattcaaccattcagacactttcagtgattccccatcatttacaaaacaaagtacaggcttcttttgggtcttttgggtcctctagatctgaccctaactggcctttccaaatgtgctcctgattattctccacatacttcagccaaacttaaataatcaccggtcatcagacattaatttatttttcaacatctctgctttggttttgttttttttgcatcactgaggatcttcatcctctacgtttacctgtcttttcaaaacctggctcatatgctaccactgtcctcacaccttttcacattttccctttcaagaatgttatacccgtttccttcttgaaatagtaatgtatcatttatggtactgtcagttgactttggttcacagtagatttattcggcatctactgcatgctagaccctgtgctaggagttaataccccaactgcaaagaagtaaagtacctaccattaagctgccctcagtctaaccctccacgtgcagtaacagaaagtacatgcaaggcaagagagtgaacgcatgtcagatatggtcaacttgtggggtgagagaaaccttcatatgcatgtctgttggtagagcagggccttttaggtagagggaacaacatatgcaaagaagcagagacacagaatagcatagtgcgttggagtagtttagtattgcttcagcatggaagttaggggagggatggtagagagattgtgggggataagtcaggagactaaagtagggatggagcacaaagagccttttatactctgctaagaagtatggactttttttctgtgagtagtgctaagccattgagttttaagaatagcagtgacatagtgttaaaacataagatcactctggcagctctgtcgagtggagtagttagaggagtggagttggcgacacaggacaagagggggagcttttataacagttcaggcaagaaataaaagcctgaacagttaggttgagtatgtagatatttgggtatatcctatcactggttctagaccaggaatccagccaactaccagtttttataaataaagggcttttttggaacagtacacattaatttgtgtactgtctatggctgcctgcatgctacagtggcagagttgagtatttgcaataggggctgcatggcccacaaagcctattttagtgcttttattttaggtactatctgccactttacagaagtttgctggcccttgttctagactttaaatccttatcttattcacctcagagtctcccatagtaccccaaatagatctaaataatgagcacatggtaggtgtccagtaaattatttttcttttttttttttgaaacagagtcttactctgtcgcccaggctggagtgcagtggcacagtcttcgctcactgcaacctctgcctcctgggttcaagtgattctcctgcctcagcctcccaagtagctgggactacaggcatgtgccaccacgcccagctaattttttgtatctttagtagagatggggtttcaccatgttggccaggctggtctcaaacccctgacctcgtgatccgcccgcctcagcctcccaaaatgttgggattacaggtgtgagccaccatgcccagccaatattttttaaatgagtaaacttacgtaactattctgaatcacgctctatccataagtcataatttccctacataatagaggtggatttgttctagctcaagaatgccaaaggtttggatggtgtgggaatattgtattgggtctttatataatggatccattcagggactatgtttttattcttccttgtttgtttgttttgagacggagtctcactctgtcgcccgggctggagtgcagtggtgcaatctcggctcactgcaagctccaccttccaggttcagccattctcctgcctcagcctcccaagtagctgggactacaggcacccaccatcacgcctggctaagtttttgtatttttagttgagatgggatcaccgtgttagccaggatggtctcgatctcctgacctcgtgatccgcctgcctcggcctcccaaagttttgggattacaggcgtgagccaccatgcccggccatgctatactgttttaataagaagagatggcaacttcaagaaaaatgatgtaaacagtgtgaaaactggtccctaccatactgatctttcatctcagaccacatgggtgcatcttgatgtaatccacagtaactagtttactagttgtcatatttttcatatgtgttggccatggaatttttctcttatttagtcatctgtcattttaactacaataatcctatcccaaaatttcactttaagccgttgtctcagtaagaaacatgctttcttcaagcatatattgggtttatctacatatgaggcaatgagggatggtgggaagatcgcagatatcgtagtcagaaggtgtggttatgcattatatttcttccacctttttgtttctgacctgtcaaggggagacactacctatctaatcagatttttatgagaatgaaagcaaatactttatataaaagtgccttgtaaactctataaatgctagttatctccatttttttaattggctgatttgagaggatatcagtacttttcaatatatgaatttctgatttttattgactctttgtagttacacattttctaattgtaaagctaaaatgtttgtcacccttgtacataatatattatccttctgatttgcaagtaagcagtagtgcaaatagttcatgtttccatcacttttttccacatgatagaattatctgtaagcttcaggtgatatgtattgacttgcgatcattgctccttgtaccaaacagctcctaacttttcaccatatcaatggaataactatgtaggcactttagggatgagaaagctatgtaagacactaaccttacccccaaaaagaaatattactaacatttcatcttctgcattttaaaaaatctgcattgtcagaaggtctttaaagactatttttccaatgactcgtccttggctaaacaaaagaagtacagttttagtcttccattgctatagatgtttgtagctttaatagtgattgatgaataaatatttaaattgaaacttataaagttgttactgaactttaaaacattcaaaacgtacaagtgttatgatgttctttctttgtattttaaaaatccattattggtgttattttgcttccttttcaaaagattgaggcctaaagaaagatttagtcaggtggactaaacaggtctttcctgttaaactgttttttcaggttttctgagacaagtggaaaatctggtcagaaacacctgttgttcatgtcatttatacttgaacctatgattgcggtcaactaaaattcatgtgacatttggttgtttttatcttgaaaggaatttctgcttcaggttgagaagattcataacccaaattttttctctaatctgttgtgaggaaataaactgaggacacacacacacacacacacacacactttctctcacatacactttccacctgagtcaaagctctaagttatgtttacagaatttcataaaattatttcttatttttttgcagaatttttgattgattaaggtcattctacccttaatttaagaggaatgataagaactttgaaaggtcagatttaaaaggttatgaaatttaagggtgaccacttgatatttgctagtgttgaaatacaagtttattagtttctgcaggtataagctgaaagatgctgcctcttctatattgattagctgttataaataaaatgcaggaaaaatgttgctaattcaaacaaatgagaaaaggttttctgaaaaagtaaaaattcagaattatagactttttaaaattttacaaattttgataaaatgctaaaagtcagctaagagcagtccttagaaaatttattttaatgagcaggtaggaataattgacaattggaatattgatggcttacaattatgtaacttacagaattccttatgtgcctgaaaacagtttgttttgaaatacttcttccccacacccatcttaattcacttttaagaaaggactcagcaattaattgggtgagtcttttcttaataattagcaaaatgacaagttttataccagcttcagtcctaaaatctatcgtattttttggcaaattttgaaagatgggcaagatttttctttcatactgctgtatgtatctatcatttgaattcggttttactgtaagagaatcagaatgcaaaatattatggtaaaaacctaggcctgtgtaggaaagaggtgtttaaagtgaggctggtagctttgttgagattttaatgtttcggtcagagctcttgtcttccctttggcctgagagtttgtatcttgtagaatcctttcagatgtatcaaaaagtttgaatcagagttaaaacttttatataagggtatctaggaaggaagtcctgtatctgccttttataacttatggaaacccccaggtttgtataagtataaaatgagataatgtgatatggtgaaatgagatagtgtgtatgaacatactttataaactataaagaactgtagacatttgtatattattaattatcataattctttcacggatatgcttgtttcctgtgacaccatttttctttttttcttttttttttttttggagatggagttttcttcttgttgcctaggctagagtgcaatggcgtgatctcggctcaccacaacctccgcctctcgagttcaagcgattcccctgcctcagcctccagagtagctgggattacaggtgtccaccaccatgcctggctaattttgtatttttagtagagacagggtttcgccatgtaggtcaggctggtctcgaactcccgacctcaggtgatccgcctgcctcggcctcccaaagtgctgggattataggtgtgagccaccgtgccaggcccatttttctttttttaaacttagaaatgccaaataaatgcgattaatatttatcaaacctcatatgtgccaatataagccctattaataatttaaatgtttatgtttttttgtttgtttgtttttgtttttgagacggagtctcactctgtcgcccaggctggagtgcagtggcgccatcacaactcactgcaagctctgcctcccgggttcacgccattctcctgcctcagcctcctgagtacctggggctacaggtgtctgccaccacgcctggctacttttttgtatttttagtaaagacagggtttcactgtgttagccagtatggtctcgatctcctgacctggtgatcctattgcctcagcctcccaaagtgctgggattacaggcgtgagccaccatgcccagcccaataatttaaatgttaattgttctattgaagtaaaatatttgtctctttgttactttttactttatttttaaaagtatagaagttatagatgatggctttctttttgtaaaagattcaagaatgtcaaagcatatagggaaaaatgagaaaggccatctctaacaccactttcctttccctctccagagttagccaaaatttgggatatatctttgaagtttgttttctttatataatatttacattcatatacgtatgtgcttttttaaaaaaatgaacattaatggaattatactgcagtttacatttttcacttgcaaatattccttggatagctttctgtgtcagtgtatgtaagtccccttcattattttggacaaatgcagagtattctagaatattgccacataatggaaaatataagatccatgaacacagggaccttttctgttttatttactgctatgactccagttcctcagatagtgcttggtgtctggtaggtattcagtaaatagaattaatgaataatttatttaacatatggattatttctggttgtggctgttgaaaaaatactgttgtgaaaatgcttacttgcctccctgtgcacacaaggaatcattttctagggtagccatccaaatgtcttttcaaagacatggtttcattgtcttctagtttctagtgttgccagtgagagttatcataccaatctcgttctggtttctttgcaggaaacctgttttgtccctcagaaaggttctaggactttctcttcacctttggtgctctgaaagtttacagcagtgggtctggacagatgtgtgcttcttttcatttatcccgatcatcactcactgaaccctttaaactgcagaggcacacctttcttcagctataggaaatttttttctcttctgtcttttattgtttcttctctatgactctttctgttctctccttctgagactcctgttagatcacagttaaaacttatggatatttctttcatgctttgtagcctttctgtctcactttctgtcattttgtgggatttggggcggaagggaagataaataactgtgttctgtttgccatcttcacccagcttcctgccatagttctttttatcccacaaggatgacttttttttatatctgtcacttcatttgtctcacagtctcttcctaaaaaaaatatgactcatatttcataataattgatggaaggttgatatttatttaacatgcgtttgttttatagtcagctttttttgaaaatgctttttttttcaaagccatgataccaatttaaaaattaggctgtgttgttttgtgctattggtagtgagcccagtcgctttaaaacacgtgttggtatcttaatcactcatctggtccaggcagctccaagtgctgataaaggccttgatgcttctccagatgtctaaatgctagctccaggtgcagtaagcagactatttggagctggcacatagattctgaagcacaatgtattaatacaaatgaaagttttaggttcttggtctcctagagtaatggttcttaagcctggttcagtaccagaatcacctgtggtacttggtaaaactataaagaccctctaataggcctgttaaatcaaaatcctgtggggaatgggactgagcgcctgtatatctctgaaggctctggaggttattctgatatgcagccaagtatggctgtgttttcatttctgtatatattttctttttgtatggatttttcactgttcttactctctgtatgtattttttcttactcatgcctcatgagttaaaatggctatacagtgtcccttggtacagatgtgttctaatttacataactgatcccctcttggtagacattattaatatgcttcccatcttttttcataacaagttactttagtagatatacttgtacatataactttgtacacatttgtgaatatatttaggggataaattactagaagtggacttgttcagaggatatatatatttgtgaatttgagagatgtgttttctttgattccaatttttaaaattgttttaaaatgcccataaaattgtccgggcgtggtggctcacgcctgtaatcccagcactttgagaggccgaggcgggtggtcacaaggtcaggagatcaagaccatcctagctaatatggtgaaaccctgtctctagtaaaaatacaaaaaattagccgggcgtggtggtgggcacctgtagtcccagctactcgggaggctgaggcaggagaatggcgtgaacctgggaggtggagcttgcagcgtccgagatcgcgccactgcactccagcctgggggacagagtgagactccgtctcaaaaaaaaaaaaacaaaaaacagaaaaccataaaatttaccgtgtaaccattttaaatgtacaattcagtggcattaaatacattcttaatgttgtgcaaccatcactaccattcatctccagacctcttttcatcttgtaaaactaaaactccatacccataaacagtaactccccattccttcctctccctatcccctggcagccaccattttactttctgtctcttggatatcagctactccaggaacctcatataagtggattgtacagtatttgcttatttaacttagcgtatggtcctcaaggttcgtcatgttgcaggatatcagaattttctttctttttaatgctgaataatattccattgtatgtacgtaacacattttgtttatccattcctctgtcaatggtcatatggatttcttccacattttagctattgtgggtaatgctgtcatgaacaaggctgtacagatatctcttcaagaccctgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaattgaatatattcttaactattcttaaatcttggaagtccttacattttgtttttatctcttcttaggccagtactaaagtggaagtggacatggagaaagcagaaagcctgcaagtgatgagaggagacttccttgcttctttggagaatgatatcaaaccagtgagtatgcccattgagtgatatataggccaaaaagtaatgataataataactcaggcgaaacgtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcattcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcgtgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattgcacactccttatgagaatctaatgcctgatgatctgtcactgtctcccatcacccccagatgggaccatatagttgcaggaaaacaagctcagggctcccactgatgctacattatggtgagttgtataattagttcattatatattacaatgtaataataatagaaataaagtgcacaataaatgtaatgtgcttgggctgggcatggtggctcgtgtctgtaatcctagcactttgggaggctgaggcgggcggatcacgaggtcaggagttcgagaccagcctgaccaacatggtgaaaccccatctctactaaaaatacaaaaattagctggatgtagtggtacgtgcctgtaatcccagctactcacgaggctgaggcaggagaatcgcttgaacccaggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagttttttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctcccgggttcaagcaattatcctgcctcagcctcccgagtagctgggattacaggtgcttgccaccatgcttggccgatttttgtatttttagtagagacggggtttcaccatgttggctaggctggtctcgaactcctgacctcaggtgatctgcctgcctcggctttccaaagtactgggatctcagcatctgtttgtttttaaaccttccctagtctgtgcttatgtgttttgcttgtttgttttttgtttgtttgtttgtttgtttgttttttgagatggagtctccctctgtcacccaggcgggaatacagtggtgtgatctcggctcactgcaacttccacctccctggttcaagcagttctcctgcctcagcctttcaggtagctgggattacagtcacatgccaccatacccggcttatttttttgtatttttagtagagacagggtttcaccatgttggccagactggtctcaaactcctgacctcaggcaatccgcccgcctgggcctcccaaagtgctgggattacaggcgtgagccactgcgcctggcctgtgtggtttttaaattaactttttctagtctactaaggtttactcagacctttagcagttgttcttggatactgactaggcccaaagtcctcttctcatcaatgtattggcaaatacactcacttgcgatgtgatatgagaccctgaggtttacctcccaaacagcaggatgtctgttttgagagtttcctggccaagtggtggaaagtaccatggaaatggagtcttccttgcttcttacttaacttgagtttggaccatagagaagtcattcttgtgtggacctcagtttactcacctgtacagtataggatggactagatgatctaatgatcaggggattggcaaacttgttcttagggcaccaattagtaaatattttaggttttgcaggccacctggctatgtcacagctgctcagctcggccctggtaggatgaaagcagccatagacaataagtaaacaaatgagtgtggctgtgttccaataaaactttatttacaaaaacaggctgtggccggccatagtttgttcaccccatttttgagctcttgacattctttagtctgtgatttcgataattagtttaggaaaaaagctttgactttcataaataatgcttctggaaatctagtaaaacctttaaattttggccaggcatggtggctcacacctgtaatcccagcactttgggaggccgaggcgggtggattgcctgagctcgagagttggagaccagcctggccaacatggcgaaacctcgtctctactaaaaatacaaaaaattagccgggcgtggtggtaggcgcctgtagtcccagctacttgggaggctgaggcaggagaatcgcttaaactcaggaggcggaggttgcagtgagccgatatcatgccactgcacttcagcctgggtgacagagtgagacttcatctcaaaaaaaaaaaaaaaacctttacattttatttttgctttttccctttatcaggaaagtaatgtagaaaatttagaaaacccagaacattaatattttggttcctctcattaggtaaccatctttgggtggacatgtgtacatacatacatacttttttttttttcttttgagcaaaaaagtacatactttttctttttttctcttctgtcacccaggctggagtgcagtggcgcgatctcggctcactgcaacctccacctcccgggttcaagcgattctcctgcctcagcctcctgagtagctgggactacaggtgctcgctgccacacccagctaattttttgtattttttagtagagatggagtttcaccgtgttgcccaggctggtgtcgaactcctgagctcaggcgatccgcccgcctcagcttcccaaagtgttgggattataggcgtgagccactgcacctggcacatgtatatgtatgtattttttacaaaattggatgaagtataatttatttgctaaatattttcacttatgccatgatatcttatttaatctttaatttgtctatgaaaatacctgctctgctaggggacttctagttgaaaactcattaatttaaaaaattaattttgaattcagccacctattcttttttctaattgtttcttgtagcttttgctttgattggagtaactttattctaggaataaagttgtgtcatctgcaaacatgaatcatgtacacatctgattttcttatatttatgtctcctttttctcttcaaattacattgcctttaccattgatgggaacctgggtaataaagaaaaaagaaaaaaattgcattccctaccacctcctccaaaacaatgtcaaatgttagttataatgataggcatcttagtatgctatcccaatttaatggaactgttgcagatatttaatggttaactgttggtttgagacctttaatgtgttgagtatattcacctatttcaattttttttctgtttaagtttttttttttaaaatcagatatggctattatattttgttaaatgacatcttagcatcttttaagatgatcatatagttttcctcctgcatgctacatattaattacagtagtgtatattcatagaattatattagtagatcttatattgattcacccttacattcttgcagtgaacctctcttgatcatattattttttcatgtactgtttgactttatttatttagttttgagacagagtttcgctcttgttgcccagggtggagtgcagtggcgcgatctcagctcaccacaacctccgcttcccaggttcaagcgattctcctgtctcagcctcctgagtggctgggattacaggcgcccgccactacgcctggctaatttttggtattttcagtagagacagggtttcaccatgttggccaggctggtcttgaactcctgacctcaggtaatccgccggcctcggcctcccatggtgccgggattacaggtgtgagccatcgcgcccggcccgtttgacttttaaataggtattttaattttttagtttatacgtgtacagtgcataatgtatttaagattcatctgtgttgttgtatcagtagtttctttattgctgagtagcagtcctttatatgagtgtatcacagtgcatttatctgttcaatagttgaatatttcaattatttctagtttgtggcagctatgaataaagctgccgtaaacatttccataatgttttttgtctgaacacaattcttgtttctcttgagtaaatacctaggagtatgatttctgggttgtatgtttataagaaactgccaaaactgttttccaaagtagctgtaccattttgcattcttacctgcaaatgtatgaagagttccggttgctctgtatcctccctagcacttgatattttcagggttttgttttgttttttttttttttttttttttgagatggagtctggctctgtcacccaggctggagtgcagtggcgcgatctcggctcactgcaagctccgcctcccgggttcatgccattctcctgcctcagcctcccgtgtagctgggactacaggcgtctaccaccacgcccggctaatttttttgtatatttagtagagacggggtttcaccatgttagcgaggatggtctcgatatcctgacctcgtgatccgcccgcctcggcctcccaaagtgctgggattacagacgtgagccactgcgcctggcctcaagttttttttttttttttttggccaccttaataagtatatggtggtagcttcttctggttttaatttccttgtccctaatgactaatggttctgagcctctttttatgtgcatcttttgatttgccatctgtatatcattgtttatggaaaaatactaaaatcttttttttttttttttgagacagagtcttgctctgttgcccaggctggagagcagtggcacagtcaccactcactgcagccgccaccttctgggttcaagccatcctcccacctctcggcctcccaagtaactgggattgcaagtgcgcaccaccacacctggctagttttttttttttttttaatagagatggggttttgatatgttgcccagactgatttcgaatcctgggctcaagcgatctgcctgcctcggcctcccaaagtgctgagattacaggcatgagccaccatgcctggccaagataccaaaatctttatttaagatgtttaattgggttgctttctttattgttattcttcttttattttattttatttatttatttatttatttgagacggagtctcgctgtgtcgccaggctggagtgcagtggcgcgatcttgactcactgcaagctccccctcccgggttcacaccattctcctgcctcagcctcccaagtagctgggactacaggcacccgcccccacgcccagctaattttttgtatttttagtagagacggggtttcaccatgttagccaggatggtcttgatctcctgaccttgtgatcctcctgcctcggcctcccaaagtgctgggattacaggcgtgagccaccacaccaggcctcttttatttttttagacagagtctcgttctttcacccacgctggagtgcagtggcatgatcttggctcactgcagcctgtcattcccctcgactccaggttcaaggtgatcctcccaccacctcagcctccgaagtagttaggaccacagatgcatgccaccatgtgtggctaatttttgtatttttaatagagatggggtttcgctatgttgcccaggctggtcttgaactcctgagctcaagcaatctgcctaccttggcctcccaaagtgctgggattacaggcatgagccaccatgcctggccaatttcttactgttgggtagtaagagttctttatatattttggatataagtgctttgttaggctgtgtgatgttcatacattttccccatctgtgccttgtgtttcattgtcttagcggtgtctttttcccagagcataagttttaaattttgatgaagtctgattaaccacattttttcttttacacatttggtgttcatctaacagctctacctaacccagaccttgccagactttttctgtaaaaggtcagatagtaaatatttcagccttgctgtccctgttgcagctctgccattgtagcaatgaaagcagtcatagacaatatgtaaatgaatgataatggctgttccaataaaactttatgaacactgcagtttgaatttcacataatttacaaattatcaattatattgtttcgattattagaaaaacaggtagtggattggccatggtttgctgattcctggcctgacaaacccaagttcacaaagattttcctctttgattttgttgtggtcgttgttccacaccttcttttttcactgtttccttaaggtagagtgtacatatttataagggtacatgtaatattttgatagattgatacagtgtgtaatgatcaaatcaggttaattagggtatccatcatctcagatgtttatccttttttttgtattgggaagataacaaatgttctagctattttaaaatatacactaagttattgttgactctagtcaccctactgtgcaaataaaaactgaaacgtattccttctatcttgctgagtttttatgcccatgaatcaacttgtcttcatccctacctgcttcccagcccccggtaaccatcattctactgcctatctccatgaaatcaacttcttaatctctcatatatgaatgagaatatgtgatacttgtctttctgcccttggcctatttcacttaacataatgtcctccagttctatccatgttgctgcaaacagattttattttccaaaccttaagctttatagatgacttcactttttaaatggctgaataatatcctcttgtgcatgtatacctcattttctttgatttttctttctttctttttaaatagagatgagttctcactatactgcccaggctggtcttgaatttttttgctcaagcaatcctcctgccttggcctcccaaagtgctgggattccaggctaaaccactgtgctcctttatgcgtttttttgtttttgtttttgtttttagagacaaaatcttgctctgttgcccaggctggagtgcagtggtgcgatcttggctcactgaagcctccacctcccaggttgaaattattctcgtgcctcagcctcccaagtagctgggattacaggcacccaccaccacgcccagctaatttttgtatttttagtagagatgaggtttcaccatgttggccaggctggtctcgaactcctgacctcaggtgattcgtctgccttggcctcccaaagtgatgggactacaggcatgagccactgcgcccagcccctttgtgcacttttaaaaacatatcttagaatttgtgatacatgttttattttcattttcatttggttcacaatattgtaaaatttctactatgacttactctttgacccatgatttgttttaaaacgtattgtttaattttcaaacatttagggatttcccagacatctttgttgttggtttctaatttaattccattatggttagggaacatactcgttatgatgaattaaaaaaaaatgtagaggtttgtatatggcctgaaacattgtttgtttaggtcaatgttcagtttgtaataggaaagatgtgttctgctgccgttaggtaaagtgtttcataaataataattaggtcaagttggttgatcgtgttaaggtcttccctatccttgctgatttcctgtctgcttgttctagtgattactgagaaaggagtgttgaagtctgcaatgattgttatgggtttgttctctttctccttaaaattctgtctgtttatgcttcctgtattttgaggcactgttattagatgcagaaacatttacagttttgtcctcttgattatttgacccctttatcattctgaaataacctttatttctggtaataatcattatattaaaaaccattatttggccagacatggtggctcatgcctgtaatcccagcactttgggaggccgaggcgggtggatcacctgaggtcaggagttcgagtccagactggacaacatggcgaaaccccatctctactaaaaagagaaaaatagcctagtgtggtggcacacgtctgtagtcccagctactcagaaggttaagtcaagataatcacttgaatccgggagttggatattgcagtgagccgagatcacgccactgcaccccagcctgggaagcagagcaagactccatctcaaaagaaaaaaaaaaaaacaaaacaaaacaggcctggtgcagtggctcatgcctgtaaacccagcactttggaaggccgaggcaggtgaatcacctgaggtcgggagttcgagaccagcctggctaagatggtgaaaccccgtctctactaaaaatacaaaaattagccaggcacggtggcagctgcctgtaatcccaagtacttgggaggctgaggccagagaattgcttgaagctgggaggcagaggctgcagtaagccaagatcatgccattgcactctagcctgggtaacagagcaagactccatctcggggaaaaaaaaaaaaattacttaatattaatataaaattagtgttttatattagtagtataatactgtttttgactagtgttaaaatgacatatctttctctacccttttgcttttaatctagatatcatgatattcatttattttttaatttgtaaaaatagagatggggttttgccatgttgcccaggctggtcttgaattcctgggctcaagccacctgcccacctcaacctcccaaaacgctgggattataggcgtgagccaccatacttggccatatcattatattttcaaatggtttcttgttttttcgtttttcttttaaatgtaatctgacagcgtcttttaattaatgtgttttggaccatttacatttaatatgattgatgatgattggatttaggtttcctttttattatttgttttctggttatttcttttttggggggtttcttctgtttcttttttctgcctatttttggattaactgaatattttttagtgttatgttttattaattggcttttggttatatctgtgctgtgtttttgctgtaggaattacaaaatatatacctaacctacctacttagagttagcattttacctctaaataaaatgtaaaagtattgcaaacatataggtttctttattctagcccccccttataattgtatatatgtgtgtgtgtatgtgtgtatatatctatatacactttcaatgtatgtagatatgtatctatactttcagtgtatattatatctacatgcatacattgtgtatgtatgtagatgtatatctacatacattgaaagatatatatctacatacatatacaatgcatgtatgatacctttggctactacatccttcttaaatttcctgttgccacttatgacctgatttccttgaccagttattcctccttcaaacatccctcttacatgtgatagtcctcagcatttagtttccccaactttcccctaattatcagttgactcaattaccaccaaaatatcaatgacttttttgagacagagtctcactctgtcaccaggctggagtgcagtggcacgatcttggctcagtgcaacctctgcctcctgagtccaagtgattctcctccctcagcctcccgagtagctgggaatacaggtgtgtgccaacacacccagctaatttttgtatttttagtagagacggggtttcaccatgttggccaggatggtttcaatctcttgaccttgtgatcagcctgcctcaacctcccaaagtgctgggattacaggcatgagccaccgcgcccggccaaaatatcaatgacttctagatccattttcctacctagacctcttttctaaactccagatatatatttccaactgcctgtgctgtccgccataaactccacattgtaggaaatagaaaggagttataaaagtttaggttcaaagcaaaatttaaaaactcataaatgagacaaaattttgtgatgataaaggctatggtccacaatgaagatatgaaagtaatgaacctttctataaaatgtataggtgatagagctggtccccaactttaagcctttcagcgattcaagtaactacagaacatcgttaaagtactgagagaaatgtcaatccagaattctatatccagcaaaaatacccttcaacaattaaggcaaaaagaaaaagaagaaagacattttggatgaagaaaatctaagagaatgtgttggcggaagttctgctctaaaataaaagtaaaagaaggtctttaggccaaaggaaaattataccagtggtaatactagaacttcagagataaagagcagcagaaatggtatctgggaaaatttaaaaatgcaaacggttgtttctcctcttaagctctttaaaatatgtatagtggttgaaagcaaaagttaaaacactgctgagactttcaatgtatgtagatatacgtatatatatctacatatatatacatatatatgtatatacatgtagaggtaataatggtagctattttatggagctgatctgaggataaaatgaaagaatgcattttaaagtgcttagcacaatgtctggcaaatagaaagcactctataggccaggcatggtggctcacgcctgtaatcccagcactttgggaggcctaggcaggtggatcacttgaggtcaggtatttgagaccagcctggccaacatggtgagaccccgtctctactaaaaatataaaaattagccgggtgtggtggtgggctcctgtaatcccagctacttgaagtgaggcaggcgagtggcttgaacctgggaggtggaggttgcagggagccaagattgcaccactgcactccagcctggtcgacagagcaagactccagctcaaaaaaaaaaaaaaaaaaaaaaaaggtggggggacaatgttactcttcttccttctagaaacatacattttatagaagttgttttttgaagtctagaagtctgaaaacgcaggagtcaactctgaaaaatctacagtggtttctggggttcaatcttggcatgactttacccctgcatctctgccctcagcaggtagttttgtttatgggtgtcattggttgaacagataattgttttagttgctacaataaataaaacatgatctgtgctctaaaggagtcaacagatgagccaggggggcatgagtaattgcctgtaatataattgtgctcacgctgtcatggaggaccgtacaaagtgtcagaagcacagtgccaggaggcacagcaaagggtagtagaggtgacatttgagcccagccttgaaaactgtctaggatttctcagcatttcagcaaagtaaggcaatttctgtctaaaatatataggcaaagtttttataaaaatacgagaaattaattaaataacagattatgaccacaatgcagatttaaaaactaaggtatgatgagtgccgttgaccggttcatccagacagttcagagaacagaacatccatgtagatccttcttgtattacagaatacaaaggagcggaaaattttgcctcagtaactgccaggtcattctaattaaagtacctatacattgtaatataattcctccattaaggtaacagccaatcaggtggtacagagtctgtgccattcagtcaagaaattcactcccttaacctagactgtgctggaagttcattgacaaattttgttctttggttctccatttttcttcagaattcatgcagaccacttgacttccttagcattttcttttgtgggcgtatattaatgtctttggttaagcttcagcttccgtttgcatcaatcctgttgtaatcgtgcctcctgaggcatctttttgcttcccttgcatcagtttccaaaatcctactttctgcttggtaaggggagtatccattttctttaaagcagtggttttcaaacttgcctgcacatcagaattatttggggagaaggataaaaatacagattactgagcttcacctgggattctgtagatttgagttgcatttgggattactttaaacaatttaccagatgatttttgtggcacctccacttcagttttaggaaggactgtttcgaggcagcttttcaaactttaatgaccatagaaatcacctgaagattgtgagaaactgcagatcctgatttagtaggcctgggtttaggcctgaggttctgaatttctctgaaatgtgataatagcaaatcccttgttgagtagcaaggttgttttttgtttttttcttttttttccaatatcttcatgacattcaatgagtagcaaagtttgaagataacttctggaatttcatctaatgtgtattaatttttactcatctggatcttaggggaaataacctatcagattatagggaagtgtttctcaaagtatggttccccaaacagcacaacctgggaattgttagaaatgcaagttctgggccgggcactgtggctcatgcctgtaatcccagcactttgggaggctgaagcgggtggatcacctgaggtgaggagtttgagaccagcctggctaacatggtgagaccccgtctctactaaaaatacaaaaaaaattagctgggcatggtggtggtactttttaaaatttttttagagacagaatatccctgtgttgcccaggctggtctgtaaatcctgacctcaagcaatcctcctgcctcagcctcttaagtagctaggtacaagccaccatgcccagctatattgacttgtttttgagacggagtctctgttgcctaggctggagggcagtggtgcgatcttggctcactgcgacctccgcctcccgggttcacgcgattctcctgcctcagcctcctgagtagctgggaccacaggcatgcaccaccatgcctggctaatttttgtattttagtagagatagagtttcaccatgttggccagactggtcttgaactcctgacctcaaatgatccacccgccttcgcctcccaaagtgctgagactacaggtgtgggccaccacgcctgaccatatatttacctttatgtgaatttaaaatgtgtgggcgtgaccaagtcgtctgccggctgttatataaaggagactttatcatcaacatgctcatcatcagtcacaaactgcctatttggaactcccttcagttctcagaggatggaaacattctttaagcggccttgtagaaatcctattccatgttaacatgccaaccaattttactttcccagagccacagaatgatatctcattgtatgcctcaattcaatcacctttccattttcaaggaccgatttcaattcctgattggctacttgatctgactgcttcctgctaatcttgttgcctattgtctatattccatttctcattgaattaaccttgatcaaatctgagaactctgcttagtaatgactccaggtatactatacccacttttgtagcttattcaacaccctcttcaatcctggttccacttcctgtgactgaaatgattacctgtgaaatattatttaacttttggacgatgatgtgtttctaacctgtgaccatttcacatagccactcaaatatggtaaaggtatggtaaagatgatgaaacagttacttggcatcattttgtaagtaatgagtttttagtgcgctttggaccttgagaccacttcataagctttagattttgagaatttcacagcataaagctcatcgctgatgcagtaatgaaggaaatgttctacaagttaatagatgagtgagaggagagggcattcatattagatttatttacttactgaactcagagccttgggttactacttgacccccactgttatctagtttaagggtccttttattttttgttttttcgaggtggagtttcactcttgttccccaggctagagtgcaatggcccggtctctgctcactgcaatctctgcctcccagattctcctgtctcagcctcccaagtagctgggattataggtacccaccaccacgccctgctagtttttgtatttttagtagagacagggtttcaccatattggtcaggctggtctcgaactcctgacctcaggcagtctgcccacctcagcctcccaaagtgctgggattacaggcatgagccactgctcctggccttaagtgttcttttctactttagcacatacacctagttgctgtcttttttgctttttataaatacagaaaagagaataatgttttaaaatcaaggaaaggcctaaggcacctgtgagggttttttgtttttgtttttgtttcagtgaaatgaagggaaatggtcaccagcaagaactgtggcaatgttatccaaggtgacaactgtctgtaccacccaggggctcagagcccttctgaagtttcctagatgttccgaaagtctccactgtgactcatgttacaggctggtctccgtggtagcactcaacgtttaaaaattagtcttcattgccaggcgtggtggctcacgcctgtaatcccagcactttgggaggctgaggtgggtggatcccgatgtcaggagatggagatcatcctggctaacacggtgaaaccccatctctactaaaaatacagaaaattagccggcagtggtggggggcgcctgtagtcccagctactctggaggctgaggcaggagaatggcgtgaacccgggaggcggagcttgcagtgagccgagatcatgccactgcactccagcctgggcgacagagggagactccgtctcaaaaaaaaaaaaaaatagtcttcatttctccttcccaacaagcgtttctctttctcttcagtgggaaaaagtaatttcattttttacttgctcattgttttattcattcactcaatcaacagaccatctatcctgtattgtatgccaagaactgtgctttgttctgggaatgaaaaaagaataagatatgttttcctctggcacttatggagcttataaaccagtgacagaggaaggtgcataaacaaatcaacaaagaattaactttactattcttattaatttctaatacaataaatttgactatttgtatcatttgagtttcatgaatataatcatattctacacttacaaaatgaaatagacataagaaagaactggtgatgtaagaaattcacagaaatgtgtaaaatatttcaagaattaacactcagtagatatttgcattgtcaaagaagcttatacatgcagatgaacctctagttgttttagttgcttgtaaaatgtatagaggtatgtgtatttcctctttaagcaggggtaacttggggtgggggatgggtgggttcatcttatctattcttcaggtcatgttctcaagaaggagctactgaatgggaagactgaaacaatttcttttctttgcacagttggtattgataaatctcaggtgtatccaaaataaaatctctggcaggctgtgatatttgtgggtctgtctcttgtgactttaggttcctcttggcagcagacataaggcagttgcacatcaggcccttgcctgaaacagctcctgatgccaagaactggtgaattactactttggtttcaatggatggtcagaaaggatcatcaggataaactttgtggattttctctcactaaccacgctctcctttcaacattgaaattctagactttagacagaagtattgaactgggttacagggaggggatgtgagaggccccctgccattgaggataagtggacatgtctgaattggcctgctacctaaaattaataatctcaatcacttggatggtggtgtccataattttctccactgtttgtgtggcatataataagtaatggttgcacctagcaattcatttacaaatcttacttgattttgaagccatagaacacctcaactgttagcttgaatgactggagtttagtttttatttctcagaacaaaacagtttgaagcctaattaacatcctcggaaggaacttaacactaaaactcctaacagcttcagttttctgaccttgaagaaagggaaaatgaagagaccatggtgccacttccgaagcaaagcctgaagttctgtgctttagaggtggtgttgccatcctatgattgcaggagtctggccttggcttggtggaggagcctgtggataaggcgaaggaaggtctgttttcattgggggtagaggagggtaaggagttgaaatgggaaggatctcttttttcttgctgtctaaaacttgtcttttcagacacatatcaagcctttccctctctgagctactgaagtcctgggcagaggttttctgtcttacaatacagacttttaccttaggcaatacctgacagagcctttaaataagtaaataaattgctttaataaattgatttaatacattgatttattaattaataaattgatttaatacattgatttattaattaataaatttatttaataaattgatttattaattaactaattttgagagagagtcttgctctgtcaccaggctggagtgcagtggcgtgatctcggctcactgcaacctccgcctcccgggttcaaggcattctcctgcctcagcctcctgagtagctgggattacaggcgcccaccaccacacccagctaatttttgtatttttagtagagatggggtttcaccatgttggccaggatggtctcgatctcctgacctcgtgatctgcctgccttggcctcccaaagtgctgggattacaagtgtgagccaccccacccggccagaacctttaaatttaaaattgtacagtgtacttcctgccaagaagcgtaggaggaagaaggaagtaatgtttttccagttttcggttaagaacttgctttgtattaaaatagtccttcaagtctacagccataccaccctgaacgcacccaatctcgtctaaaatagtccttcaaatatgtatctcttatagccttcagttatcccaacaaaattatctaaagatttgtttatctatttattattattttttagagacagggtcttgctctgttgcccaggctagagtgcagtagcatgctcatagctcattgcaacctcaaactgctgggctcaagggatcctcccaccttagcctcctgactagccaggactacaggcgtgtgccaccacatgtggctaattattttttctggagatggggtcttgctgtgttgtcctgcctggtctcaaactcctggcctcaagtgatcctcttcccccaggatcccaaggtgctggagttataggcatgagccacccaccatgccaagtcatcatgtaaagatttacagaaagttttgtgtaaacattgtcttttttttttttttgaagcagagtcttgccctgtcgcgcaggctggagtgcagtggtgtgatctcggctcactgcaacctccacctcccaggttcaagtgattctcctgcctgacactcctgggtagctgggattacaggcatgcaccaccatgcctggctaatctttgtatttttagtagagatggggtttcattgtgttggtcaggccggtctcaaactcctgacctcgtgatccatctgccttggcctctgaaagtgctaggattacaggcatgagcaaccgcgcccggcccattcagccttttttttactcgtagaagggcttcagtggaacaagagtctactagagatactagaaagggtactcaattgataactgacgttgagatttttttctagtattcatggccctcaggcttagggtttgaagtcagaggcagggctgtaggctaatggaggggagtaggctttcatggatgatgcccagggaggagccagattatctgtaccaaaccttttttgtttttttgagacagagtcttgctctgtcgcccaggctggagtgcaccggtgtgatctcggctcactgcaacctccacctcccaggttcaagcagttcacctccctcctgcccaccaccacactcagccaatttttaatttttaaaaaattttttagtagagacagggtttcatcatgttgctcaggctggtctcaaactcctgacctcaagtgatctgcccatcttggcctctcaaagtactgggattacagatatgagccactgtgcctggcctctttttgaaaatagtcttactctgtcacccaggctggagtgcagtggaatgatctcggctcactgcaacctccgcctcctggttcaagctattcttgtgcctcagactcccaggtagctgggattacaggtgtgtgccaccacactcggctaatttttgtatttttaggagagatggggtttcaccacgttggctaggctgttcttgaactcctggcctcaacccgccttggcatcctaaagtgctgggattacaggcatgggccaccgtgtccagccaacaaagctttttttcagtgagtgattccagcccttgatgcataggagggtggggtccataggagtgtagccttaactgatgaattaaatctctgggtgatgtgagatatgtgccaggttcttggcttatgtctccctctagtactttaggaacttcccaactagatggaggcagtaaaaatgggccctgccaggatgtacctataacagagacgttcaaccatacccttgtgctgtctgcctttaatcacgaagattatgagctaagattcgtggatgcatttttattttttaaccaacatgtagcaatgatcactcagataggcatcttaaatccattagtttgggttggatttaagaccgttgtcattcctatgaaagggaagatagcccagattgctattgagaaggctttgtcagatgcattccagaaactgttgattgtggttctaggtaaaactttcttaatcgtcgttgaagtacttcagtttcagtgagcaaataaactcattttgaaaagttaattggataaaaatatcgatatctaaaacactccctaggatgctttcatttgctaagttctttcacagcgacaggctcaaatttgttctttgtgacatttgtagaaaaaatgacagcaaatattgtccctagtttatagctataaaaggacttgcctcaggtcacacagaaaatgtttgaggcaggtcttctttaattgcatgcctatcgtacagaatagtgattataagccctggacacatggatttgagtcctaactctgtctcttagatttttgtatgcagttttaggtcttatggccagagagatttgaagatatttaatatctctaagctgcaatctttatctgcaaactggggttagtaatccaatcaaccttattgctgatattgtaagaaaaaatgagatgacaagtgtaaaaactcagaactatacttacaaggtaagcagacaaaatatgctattgttgtgattgttttctctctgaataaataaactctgctgaagaatttattagattatgtttctcgaatcgagaattcagttccagctctcatttctggcactgacatattggccaaatatgattcttatacaataatcagctgctttgctgtgagccttggaagtggtcatgctgttgaatggcactgcttgtatttcctattcagttctacagtggcacaaatgtcatagcctgtgcccaaaggaaacctggtgtttaacgagtccctgaacagagttgcctttctgcttcacaaccctgaaggcttagagactgagattgtaattaagttactacagacctttatttgcttgtaagaggtggccctgattgctctcagctttccaacctgggcagcccttctagtgaaagtcttacttccttggtcatcaactgtcaagtctgagtaatgacatttaataaccaagctaaatgtgtgggttgtctacccctccctagtatgcaaaggtatcccttgcacacactcacttcttagaccaaaagccttatagttctagtttgccttgaaggaaattgtattgtctatagagtatgtgggccattttctgcccgtaaaatgttcaaatgttttctctctctaaagctttgttcattgtatctggtggaattttggttctcagggagtagacacctagccatgcttctaatgtgaagtgtctactagcccagtggtctctattttggatttgaacttacttcgaccccccacctggtgccttaccttttaatcatgttatgattgaacatttttatttccacattttttatttcttacgttattattccttagttcctatctgtaagatcataaagtcctttgaaccaaacacagttgatatttcatacatatgttaaaaactgagctgtgagaccagacatgatgactcacgcttgaaatctcagcatttcgggaggccaagacagaaggatcacttcaagccaggagttcgagaccagcctggaaaacaaagcgggaccatgtctctaaaaaagagaattagacgggcacagtgatatagtgcctgctactctggaggctgaagcaggaggatgacttgagcccaggaattccaggctacagtgagctatgatagtgccactgtactccagcctgggtgacagagtgagaccctgtctaaaagaaaaaagaaaaacaaaaatcgaagtgtatgatgaagagatgaggaaactttcaggaaaatgcttatttcctgcttttagaaactaaaagaatgtctcattgtgggttgctaccattatatgcaggaagttttggaatgaaaaagattctgaattcatccttgctaactttatttcagaaagtggtaaaatagctatggagtacagacccagtgaagagattgtagatgtcagatgggaagaagaactacacggtttaatataagtatgtggagataaaaactcaaaggtaacagggccgggcacagtggctcacacctgtaatgccagtgctttgggaggctgaggcgggtggatcacctgaggtcaggagttcaagatcagactgaccaacatggagaaatggtggcacatgcctgtaatcccagctactcgggaggctgaggcaggagaatcgcttggacccgggaagcggaggttccggtaagccaagatcacaccattgcactccagcctgggcaacaagagtgaaactctatctcaaaaaacaaacaggccaggcgctgtggctcacacctgtaatcccagcactttgggaggccgaggtgggtggatcatgaggtcaggagttcaagaccagcctggccaatatggtgaaaccctgtctctactaaaaatacaaaaattggctgggtgtggtggtgggcacctgtaatcccagctacttgggaaactgaggcatgaaaaccactagaacccaggaggcggaggttgcagtgagccgagatcatgccactgcattccagcctgggtgacagagcaagacactctctcgaggaaaaaaaaaaaaagaaaagaaaaacaactcaagggtttgataacattgccagtataaccataattcaaaacaagcagcagaatttggaggataatttgtttaattctcaggaaaatgtgaaactctgaaactgctttttgagtgcagggtatttccggggcttttcctaaagtcttaacccttggctctgaccccttatttgaagtttggagagcagaaccgaggattgtattactacagttgtggacacaggagaggggttagtctccccccgctccaggagtaagggatgctgggctgctcgaacacaggccttgttagaactcccttcaaacaggatcccagagatgtggggagaaggtaactggccttaagaatgattgcgctacagcttttgaaaactataatgcctttcaaatatggcttattgcttggatctcaatatctcccacgtatcttgggtggaatattttgctgaagatctttctgtcaatcatttacaatcatgtgctgcaaaatgaagtttgcgtcaacagtagaccacatatatgatggtggttccgtaagcgtataatggagctatccctatataggtataccatttttatctttttttttttttttttttttttttttttttgagatggagtctcactctgttgtccaggctggagtgcggtggtatgatcccagctcattgcaacctccacctcccaggttcaagtgattctcctacctcagcctcctgagtagctgggattatagacacgcgtcaccacactcagctaatttttgtatttttagtagagatggggtttcatcatgttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaatcacctagtgacccatttctcaagctcctcacgtggcaagcaatgcatgactgcatatgaaagctcttaaatagggattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataacaatagctccatccctaaatgaggtgaatcttggaatctcttccattttattttattttatttttttgagatggagtttctctcttgttgcccaggctgaagtgcaatgttgtgatctcggctcactgcaacctctgcctcccaggttcaagcgattctcctgctttggcctcctgagtagctgggattgcaggtatgcaccatcacacctggctaattttgtatttttagtagagacggagtttcaccatgttggttaggctggtctcgaacttctgacctcagtgatccccccacctcggcctcccaaagttctgggattatgggtgtgagccaccacacccggccccccttcaattttaaagccatcactatgcaccctatgtctatgccaggcactaaaataagatgaagcaccttcttggagtttacatgctggtaattatgccagacagtaataaaataggtaagaacggctgtgggggaagtcagctgggttctagttacagtcgcatttcaggaaatgatttaacatgctgactttaacaacctaagcctcttctccatgtgtgcacacagggtagatctctgaacacaggtgaccctagaagtgctgtaacttctaggggaatggctgtgttgagtcaaggcaggatgacagttcagcctcctcccaggctagtgcaaagggctcttcactcggattaaaaccttctctcccagaccgaattgccaactcccaacacccctcctacagaaaatgtggagtcctcgcttattccctggcagcccctacctaatagggtggtgaattaattatcaaacatgcgacagtttagcgaaaatggcaacactttggaataagtgactgtaatgtgcatcctggcgcccattttgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccaccccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtgacataaataaaggtgtcataaagacagggcggggctcacgcttagaaggggcacgagcgtctcggagctgccagaatgtcttctgctcagtgcccggcactagtgtgtgtcatgtcccggctgcgtttctggggcccatggcccctccttatgtggcaactattgtggctactagttaaggaggctcagcctctggagtgggtcaaggacccgctccagctcacctctaatcccctggggccgcctgactcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaagactccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactagacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcagtgatgatgctctaagtggttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttagcatatgtaggagagttggctgttcacatgattattcagtcctttagttttgtccagaactcatttttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggcgggcggatcatgaggtcaggagatcaagaccatcctggctaacatggtgaaaccccatctctactaaaaatacagaaaaaaattagccaggcatggtggtgggtgcctggagtcccagctactcgggaggctgaggcaggagaatggcatgaacctgggaggcagagcttgcagtgagccgagattgcaccactgcactccagcctgggcgacagagcaagactccatctcaaaaaaaaaaatgataggagggaagaaagagaataggcataaaaagggaggtatatataattaagtactaaaagataatgcagaccattggtgctagaatttgccagaatctgtgatccttgaggtgtggagatgctacatgggtaagctaaaactttacttgggtcttaaagagtagccataatttgttaaataggagaaaaatgggagtacagtctaggcaaacgcatggctacaggtatggttggaatttagtagaccaatgtggctacaaagaattaggtgagggagcaatgaagatacgattctgtaaaaccttgattatcagctacaggagtttgaaagttacacaatgaggtatggaaagccattgaaagtttccaagcaagagagattacatgatcaaaacaggaagattattttattttgttttttgcattatgtgcaagtgtagacatgcagaggattgttttagaatccatatgtaaagtgtccaaaaggaaaagcttaattcagggagacaaaatagaaaggtctagcaaaatctaggagtgaggtgtgaaggggccaaatcagatcagttgtaataggagtggaaagaaaaagcctaggatgtttcaacagagggcactgggccaaagctttggtgttacctggcatagggtttctttcttctcatttgttgataatgataagcttttgcccatatttctgtggaattatttaccattttggtactgatttgtagaagtctgtttagacacataagtgcttttagataaaatacttacattcaaagtaattaactggcatcatctgtccaagagatgggatggataagaagttaagcttccaggagatgcctcatcatttgtgccggtgaccccgcataatttcttgatgaattgtgcaaactgggaagctgatagctctggaaatgagaaagcaggtgttattttctgtttctgaatatccccaacaagattgcaatgattcttttacttatcgtgttcattgttttcctacctattcaaggatataaactgtgtttcttcacagaaatttccaaggaaactatatttcttacattgatggaaatgtatggaaagcatacagttggaccgagaaactgtgagtatattctctccaaatatgacaaaaagctaactgcattgtaagatccttcttggtccagaattttgaggtcggtacctctgaggaaagatatttctcctccacgccccaaatcaaccactgttgattgcaattgtatggttattttaaaattaaatttggtaggctctctttaaaataagaggcaatttaaatttattttttatcatacaaatagtacatggttatattcctttttgttctctttttttttttttttttttttttttcagagacagggtcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtattttttgtagagacagggtcttcctatgctgcttaggctggtcttgaactcctgggctcaagtgatcctcccaccttggcctcttaaagtgttcatattacaggcatgagccaccacccgcagcccatgattccatttttaatatataaaaatgcaataacagatataacaaaaactctccttgtgccctactccctcatccctgaagtaatgctactctgcatttagtatacatgcttccagacttttcctcatttacctacatacatatttacataaagcaaaatagatttgttttgtggttttaaaattttttcttcgcataaagggtaacatcttgcaacttgattctttcacttcatgatatgccttagatttctttccttcccagtactgagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctggaaatggaattcttggggtgaagactatgtagatataaaattttaattgccttcaaaaattttgtgccaacttactctattgtcagcagaatatgacagcattcatttcccaacaccttttcaccgctgggtattctccaactttttgctgaagttatggatgaataaaagggattccatctaaatgtgaatttttctgattactcatgaatttaatttagtatctttatatgtttattgaacatttgtgtttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattattccaatgtatatagacaagccacgatgagttctaaattaaaaataaacatatgctaggcgcggtggctcacgcctttaatcccagcaccttgggaggtaggcggatcacctgaggtcaggagtttgagaccagcctggccgatagggcgaaaccccatctctactaaaaatacaaaaagtagccaggcgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagggattctcctgcctcagcctcctgggtagctggaattacaggtgccctccatcacacccagctaatttttatatttttagtagagacagggtttcaccatgttggccaggctggtctcaaactcatgaccgtgggtgattcacccaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggcatgctagcaatgatcttttgtaacgatgtttacatgggtatctgcttcataattattaaactgaatattttggccaggtgaggtggctcatgtctgcagtcacagcactttgggaagcagacacaggaggatcacttgagccaggagtttgagaccagtctgggaacagagtgagaccctgtctcaaaaattaaattaaattaaatataaacaacatttatgttatgtgcactttatgcacattatagttctccagtttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataacagaatttggtgggaagaaacccactcttcaaggggtgtgcttgagtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtaaaatgaataaggggttcaaattagataatctctcagatttctttgagcaataaaattctgcaattctgtaagtttgtatagggtctcagcccatctctagcactagctacctcctgtgcattttcagtttttaagttgtatagacaaaatacagacaaaaacatttcacatggtaagaaaatctgagcagtgactgacacccatatgaaccttgttttataagggttcacatatcattctttttctattcagtctacaaccaatagatccaatctaatttatggtctatttttaaatagcccattaagttaagaatgggttttgcatttttaaagggactgtgaaagaaaaagaaaagaaacaaagaaatatgcgagagatcatatgtggcccataaaacctaaaatatttactgtctgaccttcaccaaaaaaaatttcaaaaagttggtttagtaggatgaaaggaactaaagttaacttcagatggttgcctaaaggagaagaaaatggagaccacctgcattcatttgaacatcattaatccagaattttttggtaatttaatcggaattaaattaacatttaaatattaaaaatagctgaattatatcaatattatcatcaagaatattaagctaccaagagaatagactggtattaaggatttcatttcaggaattgttatattaaaacagatgtttaaaatgatggttaactggtagagctagaaatgtttacactaagaagcacatcagaaatgcccctaactcttcactaattacaaaataacgatcgccccagccctgttaccaagaaagggatccctgtatttctgtctgtttagagacaagaagatactatgttcattgctatgaatgcttgattcttaccctttgtccatagaggtgtgtatgtcattaatccttattaagctcattagtgatgctcttttgcaaacagattctctcaaatatagaaggcttaaggaaagtgggtgtaaagaccctcaggtggatgccaaagtgctacagagaccatgaaataataaaactacgtttcctttaaaatagttattttccttctactcactcccccctattcatttattttacaaatatttgagtttgctttatttccatgtgtcagttttaaacatggtgggcaatgcagatgagcaagacctagtccatgctttcagggacctgtttatgctcagaagaaatgggatacaaaataactacattaagaagaagaaatggatgtgggcactaggagggataaattgtttctcgaacatagaagaggaaaaaatgccttcaatttggacccaggaggatgttactagaacaatgccatttgaataggactttaaagggccattgtgtaacaccagacagacatcttggggaaaatactctaaacttgcaaaaggaaaatgggagggcaaaacacaggaaagtattcaaggaatgccatgagtacccgtagagtacaagaagggagagtaggaaaatggagccagatcttctagagctttgaatgccaagctgaggagccaacatggggaaccgtgttaccacagcagcgctgtaaggtagatctgcatcacagtcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactagagatggagacatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagtgcagtggtgcaatcttggctcactgcaaggtccgcctcctgggttcatgccattctcctgcctcagcctcctgagcagctaggactacaggcacgtgccactaggcccggctaattttttattttttttgtagagacagggtttcaccgtgttagccaggatggtctcgatatcctgacctcaggatctgccagcctcggcctccgaaagtgctggattacaggcctgagccaccgcacccggcccgactattttttttaatattagaaattgtgtatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggcagggttaggggctctggaatgttcaaatacaagtccaaacgtttagagttgagatgaaaaacaggtattcagtattattctaaactcttgctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctttttgctattcttgaaatatgattaaaattttaccagtagaaagctactaaaattatacagcaaatcctttttgtctctagcaaggattattgtgagaattattacacagatcttagtgaatcatcagagagcagtggttctcaggtggtgtgattttgcactcaggtggcatttggtaatgtccggagacagttttggttgacaaaactgtgagtgtgctcctggcatctggtgggcaaaggccagagatgctgctaaacatccttcaaggtataagacaaacccccatggcaaagagttatatagtccaaaatgttgatggcactgaagttgtgaaatcctgttctagagaaataaagatcacttaacacaggtatttactgagcattcactgttttgtatctaatgcaccacatgtgcagtgttaaagtataaatcataagccagtatcttccacagtcagatttccttagtgcatagagaaaggattgaggttatgttccatcctatataaattagaatcatggcaaatgataaatgttctgaaataattttttttttctttggcttgtgtcttttttttttagaaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcatgtcttaagatccattcatttttctcaaatggggaagctaaggtacaaagaggccaagagacttacgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaaaaatctgggcgtggtggtgcagttttttgctccctggaggactttgtgttaagcttccttccttgcagctaaatgttgcagacatttaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcaaaacctcatctctactaaaaatacaaaaattagcaggtcatggtggcgggcacctgtgatcctagctatcgggaggctgaggcacgagaatggcttgaacccaggagggggaagttgcagtgagccgagattgtgccactaccctccaacctcccctccaggctggtctcgaactcctgtgacctcaggtgatccgcccacctcagcctcccaaagtgctggggttacaggtgtgagccaccatgcctggccaagatggtgtttatgttaagctattgtgcaaaaaaaaacttttgtaaagaaaatatatcgctgtatcttaattccatatactttcctgactactcttctaccataattgcaaaaattctatgatttctctgtataacatacccatcaaatcagagtgggtatattcagtggcctgaaggggactcaaggtgaagattctcctctacatctgactttagaaaagacgttccacctgccttgtggttcagaaatctagtttcacacagttcatttcaagttagagggaggcattcaggatgtgtctggactagagcagcagtttctgcacatgctcccctctgtcctcattaatttgctgatgcataacttaggaaaagtacactaaaggtctgtttttcttttgccctcacaccagagaacaggctcattaggtccctccaccaagaggtttaggtagcatcaatacaaatgttttaaactcaccatctttactaagcactttatacaactgggagtccctcataaaaatctggtggccgggagcggtggctcatgcctgtaattccagcactttgctgaggtgggtggatcacctgaggtcaggagttcaagaccagcctgaccaacatggtgaaacctgtctctactaaaaatacaaaaattagctgggcatggtggcaggcaactgtaatcctaggtactcaggaggctgaggcaggagaatcacttgaaaccaggaggcggaggttgcagtgagccgagatggcaccattgcactccagcctgagggacagagtgagactctgtctcaaataataataataatataataataataatcatcatcatcatcatcatcatcatcatcatctagccagcttcactacaattatgtaggcaacaccaggaaaacactggaatcacagttgataaaaattaatgaattcactcaaaaacattcagagtgtcatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggcccttttggagtcaaatcttcctggtaaacaaagctacactgcagtcatatttggcatatgtgacatataggcccactgcatttccttccaaaggcaagatgccaagggaaggtgccagtaattttatgaccaatatgacaccattttgtggtgtttgtaagttgaaacaatatatttccctgcattacacaagtttataaaaaacaaacaaaaaaagaggccccagctgtggttgatcgatgatgaatagagcctaaccttccaggcttctcacttgcacaggcccttccaaggtcgtgggagggcccctggaaatttttgtattcataatttttttaatgtttttactagataaggctcaggccccacaaaatcctgaaatcatccctgggttccaatagttacaacccagtaaatctcttgaatgaagcctctatgttattgacaaatactgactggccaagttagcagggtgatagggtctgtctattttgaatctgaaatccatctcaaagacaggccaagagcttattagtggacttaactggattctgctggcccaagcgcagtaaagtcaaacaaccatatcgaggttttgcattggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcacatattggcttgtctatggcacatcgatatcatgccaagaatgtaagcactaagagagaataagaggaaaatccaggctttatccctattgaattatttatcccactattagaatactagtgaggtaggtgtggccacactgtgatggcaaattgagcttcggtcacaaacatgccttactgttccccccagtctactgacatcagcttcctttacatagcggtagatgcacaaaagtttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcttcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgtagatgaggaagttgaaactcagagacgctaggtaatttgctaaggttcacacggctaataagtggcagaaccacttacaagctttgcaaataattttcaatgcagctcttagttcccctgtaataggagctgaatgatgacaatttggctttgtgtgcattgtatcttactttctaacttgaacaggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaacgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaggaaaaaggctcaccatttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatattgggtgagggtctaggtcatctgcttatttctttgactaccttcttccatggaaccagttttccctgacagccttgggattctagcatagatcattttggagtttgtcatttaaatttattttcacagcctgctttggacattttttcagctagagctgttaggatttcagtacatttaagacagtgatgacatgctccagtcctttcatctctctctcctcagttaatagaaaggaaacatagctcatctatctggacctgtacagaagaatttggagggaaaaaaaagaacaagcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctgaaaaaaagcttgccacattttacttccataaagataccaaaaaggcgatggactgggagtcagtgcaccttagtttaatgtataaaatgaaggacttgaaccagaaatggaaatggtcatctactgtgaatctaaaaacactcaaggctgggcgcgctggctcatgcctgtaatcccagcactttaagaggccaagacaggcagatcgcttgagcccctggagttcaagttcagcctgggcaacaaagtgagaccccaatctctacaaaaagacttttaaaaagtggaaacataaatataaataaataaaaacactcatatcatttggtttgtggaaaagagttgctgtagagtcctcaaacttgagccgttgagccagttcccactcagtctctccatggcccaggcacaaccttagtcaagaaaagaatgccttagaacaggaggaaaagaggataatatcgaatggccctatattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgccaagttgtttggctacatactgccttacagtcattatttttggtgtttagaaaaaaatagaaacagggtctcactttgttacccaggctggtctcaaactcctgggctcaagctttccttctgctttggcctcccaaagtgctgagattacaggcttgagatgctgtgcccagcctacattcatttttaatagctgggaggaaagtgggcagaggaagatatagaatgaaggggtagccgactttgtacagagcccaccagtggtcttacaagttttcatgccaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaaagaggagggggatcacaaggcaggacaagctgtgtggctcccagcctcgccactgactcactctgatcttggtcaagggagaatgaatcttcactcctcttttttccatctgccagcatgtttggtcttctggcacctggtgttctatacagtacaacatgcttctttgtgttacattgagacttgatccacgtaccatcaacgcagtattataaagtgtacaattcagtggtggttagtatattctcaaggttgtatagcaaacaatcaccattatctaaccccagaacattttcatcatcccaaaaagaaacatggtacccattagccatcactccccagtgctgtcttcccgcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatgtggttgtttctactttattttggcttttatgaataatgctgctatggacatgcatgtactactttttgcgtggacatgtttttaattctagggtgcatccctagcagaattgctagatcgtatggcaactcttatgtttaactttttgaggacctgtcaggctgatttccacagtggctgctccattttacacttccatctgcaatgtttgagggtttcaatttctccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatatatcttctttgaagaaatatttattcacatcctctgcccatttaaaaaattgatttgtctttttattgaattataggaatttctctatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgaaatttactcccatgtttttgtgtaagagtcttatcgttttggctcttacatttaggtatttgacatattttgcatcaattcttataatcgtgtgagatgtagggggtccaccttcattattttgcacatagatgttcaggtgacgccattacactcaagcctgggcaacagagtgagactccaatggagacggggtttcagcacgtttatcaggctgctctcgaactcctaacctcagatgatccacctgcttcagcctcccaaaatgctgggattacaggcatgagctaccatgcccagccaataaatgaaaactttttcactcaaaaaaacaacaattgtagtgaaaccatagatcagtttggagaatcatgctattattatctgcttcatgtttacagaatactccgttgaatttggtttgccagattttgtcaagcatttttccatctacattcataagaaatactggtctgtaattttttgtgtgtgatgtctttagtttggataccaggttaatatcaccctcatagaataagttaggaaatgttctttcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctttttatgtctctaagaacaatagtaatgtcccctctcatttctagttttaataatttggtcttctgtatttttgcagtgcagtggctcacacctgtcatcctagcactttgggaggctgcggtgggaggattgcttgaccccaggagttcgaggccagccagggcaacatactgagagcttatctctacaaaaaaaatgtaaaagttagctgaacgtggtggcacatgcctgtagtcacagctactcaggtggctaaggcaggaggatcacttgagcccgggagatcggtgctgcagtgagccatgattgttccactgcactccagcctgggaaacagagtgaaaacctgtcttgaaaaatgaacagtaagaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttagccgagtgtggtggtgcgcacctgtagtctcagctacatcttaattttataacgttgtagttcagattaattccaactttgtttcaatggtatacaaaaactttgcttctctaaagctccactctcaccccctcctttatactgttattgtcacacattacatctttatataccttatgttcatcaactagatttataattattgcattatgtaagtatctttttcttttttttttttttctttattttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccagccagtgctttttatttctttgtgcagattcacgttagtactccttatagggcaggtcttctagcaacaaagtctctcagtttttatttatctagaatatcttaatttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgcagtggtgcaaccactcacaacgttgcagcctccacctcccaggcttaagcaatgctgtcacctcagcctcctgggtagctgagactacaggcatgcaccaccatgcccagttttttttgtttttgtttttgttttttttaatttttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgactcttaacgagcatgctgctttcaagcatctgtttaacaaagcacatcttgcaccgcccttaatccattcaaccctgagtggacacagcacatgtttcagagagcactgggttgggggtaaggtcatagatcaacagcatcccaaggcagaagaatttttcttagtacagaacaaaatggagtcttctatgtctacttctttctacacagacacagcaacaatctgatttctgtatcttttccccacatttcccccttttctattcaacaaaaccaccatcgtcatcatggcccgttctcaatgagctgttgggtacacctcccagacggggtggcggccgggcagaggggctcctcacttcccagaaggggcagccgggcagaggcgcccccccacctcccggagggggcggctggccaggcgggggctggcccccacctccctcccagacagggcggctgccgggcagaggggctcctcacttctcagacggggcggctgctgggcggaggggctcctcacttctcagatggggcggctgccaggcgtaggggctcctcacttctcagacggggcggccaggcagagatgctcctcacctcccagacagggtcgcggccgggcagaggcgctcctcacatcccagacgggcatgcccagttattttcaaattttttgtagagacagggttttactctattgccagtgctggtatccaactcctggcttcaagcaattcttgagcctcaagcctcccaaggtactgggagtacaggtgtgagcaaccatgtccagcacctgcattgtttttgaagagaaattagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccatcatttcttcaaatattctttctccttttttctgtttttcttctcctgggacgctcattatgtgtatgttagtaagcttgatgatgtgttccacaaacaggtctctgagattccattcactttcattcatttttatttctgttcctcagagtcaacaatctcaattaaccttcaagttccccattctgtcttcagcctgctgtaatgtgccattgagaacctctaataatttttccatttcagttaccatacttttcaactctagaatttctatttgactcctttttatggtttctatctctttattgatattctctatttgatgagacattgctttcatactttcctttagttctctagtctacagaactgaatcgtttctcttatctctttgaacatattttaaatagctgaattaaatccttctctaggccaggcatggtcgctcgtgcctataatcccagcactttgggaggctgagactgaggttgaggctgaggccaggagttcaagaccaccctgggtaacttcgcaagaccccacctataaaaaataaaaaaatctttgtctagtaagtctaacatctggtccttctcagggacaatttctgcttatttctcccccaaccacgtgtttgggccatactttgtttccttgcatctttcataaatgtttgttaaaaattgaatattttaaataatataatgtagcaattctgaaaatcagatccatgctgccagggtttggtgttactcctgcttgtgttagtagttgctatttatttagtgacttttctgaacttcttctgtaaagtctcgcattatatgtcatgtgttcccactaaagtccctcctcggttagcttaccgatcaggtaatgattaaatgaagatttacttaaattcttggaactgataagtctcctagtttttgccaaggggctctgtgtacatgttggggcataccttcagcactcagctagacaatttacagccatgccttagctttcacttcttgcttgtgcagaacctcaaggtgtcagccaggggtgagagtttatgaacttagtaggtctttcctgaccatgctgacagtctgccctatgcatgcgcgtgacattccaaattgccaggaatatgtcttatggacttctagtttcccaagcatatatcagagtgtttcaaattcctgtggacatcttattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctggttggggatgtgggctgttttccaaggcgactactgagctagagggtgaggaatggtctaaggcaagttaacacaaatctcactgttcttacagaaattttttttgaataaatgctccttgggttgctgcaagactttggttacatttctagagttctgaaaaagtttattgtggtcaatttttttttttttttttttttttttttttgctattttttttggtatttgttgcttttatgaagggatgaatttttggatgtctctttttttttttttttttttttttttgagacagagtctcactctgttgtccaggctggagtgtagtggcataatctcatctcactgcaagctccacctcccgggttcacacaattctcctgcctcagcctcccgagtagctgggactacaggcgcctgccaccacgcccagctaatttttgtatatttagtacagacggggtttcactttgttagccaggatggtctcgatcccctgacctcgtgatccgcctgcctcagcctcccaaagtgctgggattacaggtgtgagccactgcgcccagcctgcatgtctttattccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgctctccagcctgggcaacacagtgagtgagaatgtgtctcttaaaaaaaaaaaaaaaagtctcattgaccatagactaataaactatttaatcatgggaaatgattaggggaaagacataaaaagagaaactgtaatccacttttttttgctctgtcgcccaggctggagtagagtggcttgatcttggctcactgcaacctccgcctcctgggttcaagcaattctcctgcctcagcctctgaaacagctggaattacaggcaagcactgccgtgccctgctaatgagaaattgtaattctcatagaggtcctcccagaggagtagaagaaggttgaaaggcacttctgtatttagtcttctcacaattaaggctgggcccagtggctcacaccagcactttgggaggccaaggcaggcggatcacttgagatcaggagttcaagaccagcctggcaaacatggtgaaactcccatctctactaaaaacacaaaaaatagccaggcgtggtggtgcgtgcctatagtcccagctatttgggagactgaggaaggaggattacctgagcttgggaagaggacgttgcagtgagccaagatcacgccactgcactccagcctggtcaatggagcaagaccctgtttgggtggggaggggaggggagtggaggggagaggagaaaggaaagaaaggaaaggaaagaaaatagaaagaaggaagggggagggaaggaaggaaggaaaaagagagagaaaaagaatgaagaacaaaaatgaaaattttttaaaaacctaaggttaaaataaaccctttttcttcatacagattaaacacgagttcaaattacagctttgctgcttaatagcttggtgacctaggacaagttatctaacctctctgtgcctcagtttcctcatttaaaaatagggcaataataatatctaccacataaggtatttgctgatcacaaatacctggcaacccagtagatactcactgtaataattattatttttataatttctgcctaagtacaaagatgattcttgggttaacctaaaggtagattttcttttatttcttcctgtttcttttatttttcttgttcaccttaaagaattaaaaagaaaatcgattccagcattttggaataaaaatttgcatcaaaatcaatttattcattttattgacatatgaacaaaatgtcatttgtttattcaataaacatttgttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaaaaaaaaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggtagatcacctgaggtcaagagttcaaaaccagcctgaccaacatggtaaaaccccgactctactaaaaatacaaaaattagctgggcgtggtggtgggtgcctgtaatcccagctactcggaaggctgaggcagaacaggagaatcacttgaacctgggaggcggaggttgcagtgagccaagatcgagccattgcactccagcctgggcaacaagagcgagactccatctcaaaaaaaaaaaaaaaaaaaaaatagatgaacaacttgaattatgatgagcaacttgaattatggaggatgctagaaatactgtttcctccacagtcagggcttcctaccaacatagtcacttttagggtttttgacctgaaaagttctgtggcatattttttctttgctatccactttttttttccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattccattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaactaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaagtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaatttttttttttgtttttgaaatggaatctcactctgtcgcccaggctgcagtgcagcggcatgacctaggctcactgcaacctccacctcccaggttcaagtggttctcctgcctcagccttccgagtagctgggattacaggcgcatgccaccacacctggctaatttttgtatttttagtagagacaaggtttcgccatgttggccagggtggtttcgaactcctgacctcaagtgatccgcctgcctcagcctcccaaagtgctaggattacagataagatccaccttgcctggcctcactcagcagaattttttttgagattatgctaccatccatgttgttgcacctatcactacagctggccctccatatctgcaggttcctcatccatagattcaacgaaccatggatggggaatatttggaaaaaataaaatatataaaacaacaatacaacaataaaagcagtagaaaatttaaaatacagtataattatgtacataccatttacactgtattaggtacttagagtatacctgaggctgtatacaaacattatgtcatttcataaaaaagaactcagcatctgtggactttggtatctgcagggggtcctggagccaatcccctgcagacaccgagggacaactgttcactcctttttattgctgagtagtattccggttgtgtggaaatgccatctctactaaaaatgcacaaactaggcaggtgtggtggcacatgcctgtaatcccagctactcaggaggctgaggcacgagaagtgcttgaacttgagaggtggaggttgcaatgagccgagattgcaccactgcactctaacctgggcgacagagtgggactctgtctaaaaaaaaaagtaagaaataaaaatgttttctgaagagcagaagtttttaattttgaccagctttaagttagcatttttttcttaaatggcttgtgattttttgtttcttacctaagaaatctttaagaacctgttgtctaatccagcgtctaaaagattttctcctatgtcttctcccagaaatgatacacatttaggtctatgatccattttgagttaatttgcatatgtgatgtatcttttttattttttatttttttgtagaaatgaggtctcagtatgttccccaggctggtctcggactcctggtctcaagtgatcctcctgcctcacctcccagagtgctgagattacaggcatgagacaccgtgcctggccttctttgcaggatatatatatagatatagatatatatataaatcagccaggtgtggtggcacacgcctgtagtcccagctactagggaacctgagtcaggaggatcacttgaacccaggaggtggaggttgcagtgagccaagatggcaccactgcactccagcttgggtgacagagcaagaccctgtctaaaatatatatatatttatatatatgtacgtgtatatatgtatatgtatgcctgcggggccctattgtgagtttgttacacaatttactgcaacttcaattgtgccaccagcccccacaatatggcaagctaaatagagactcagttatgctagggctggttgagggcattttgcaagattagcatggaaagggcccttcatttagcactctgctccgttcatttttgtcaggtcactttcttatcttgaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaaatgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagatttgtcagtatactttaaaacaatcctgggaacagttctagattgaaggagactaaagaatcatgtactaagtgtaatgtctgatgtttgattggattgtgaattttttaagccatgttatgattgggacaattgtgaaaatgtgtatacggaccgcatagtagacaatgataatatgaagttccattgagtgatgatagtcctctggttatgtcagagaatgccttggttcttaggggctgcacactgaagtcttcaatggtgaagggtcattatgtctgcaactgactctcaaatggttttgtccagaaaatgtatagacatacacacacggaaagctaatgtggcaaagtattagcaactactgattccagatgaaagttatacaggtgttcattataccatttgaaaatgtttcccagccatcctaaggcttaaaggaaaaaaagaaaatgtttaaaataaaaacttgggggcagaaaaagaataccaaaaattttgggctcatgcctgtaatcccagcactttgggaggccaaagagagagggttgcttgtgcccaggagttcgagaccagcctggacaacatggtgaaaccccatttctacaaaatatacaaaaattagccaggtgtggtggcacacacctgtagttctaggtactcaggaggctgaggtgggaggatcacttgagcacaggagacagaggctgcagtgagccaagattgcaccactgcactcagcctgtgtaacagagcgagacccggcctcaaaataaacaaaagaaacacctttgtggcagaggtaaggttgctatacaacaaaatgctgggttacggttccgggtccattccatatgaagatcagaggcttccactggacccaaaggaatactactagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactcactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatctttcatgacactggcattttttaagagtcaaagatagttgtcttgtaaattgtcccacaatccagatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaaaaaaaaaaaaaaattagctgggcatggtggtgcaagcctatactcccagctactcaggaggctgaatttggaggatcccttgagcccaggggggttgaggctgcattgaggtataattttgccactgtatttcagcctgggtgacaaaataaaaataaaaataaaaaataataattttccccttggtaattaataaataatctgtgggttgttactttgagttcagtgaagatcctgttctcaaatgttttttcacccaaatgtgcatcaatgataatccttgtctgaatgaatttgtattacactgacggttgcaaagtgacacttttaaaaattctgtcattccttctacatttactagctggcattatttcattgaagaagaactcctcctctttctttttcaatatcactcttcgtggattcttctttatattaaatatgtggtaacttattgttgttattcttttgaatgctcaaattgtccagatttgaccaatgcagtctttgttattttttaactccgcaatccaggttaaactaagctatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattccagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaacaataatacaaaacacacaactgcaagaaatgcctttgaagaaaatgattttatggaaaacactaacatgccagaaggaaccatctctgaaaacacaaactacaatcatcctcatgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccagctacttggaaggctgaggtgggaggatcacctgagcccagggaggtcgagtctagtgaacggtgattgcaccacggtacccaagcctgggtgacagagtgagaccctctttcaaaaaaataaaaaagaacctgtcagctactcacctggaatactggggttttgaatagttagctctcattctggttttttttttgtgtgtttttttttttagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttactgcagtgtatatttcaggatttttaaaggatcctcgctttcagatctctgtgaattgaaaccatgtgaatcccactagactattttaagaagtcgaaaatttctcccacccaaaactatgtcaacaattggatgtactcatcaagtcacccttactctgccactaatttatttccttgttgctgaaatgatgagagaggtataatctccaccctcacggagttgtcatcaccctggagaggaaggagagagccaaaagacatacgtattgtcttgtagacttattagatttacacagtatcgtcctccagtgtgtaaggcattgtctaaataggtccagttaaagcactacagagtagccatcttttacaaaaatttttggccacatttttaagttcactggtgagggggaacgtctcatactctagccctcctgagcctagaccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgccaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctagtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggcttaagggatcctcctgcctcagcttcctgagtggctgggactacaggcaggcagctaatttaaaaaatgtgttcgtagagacaaggtcttgctatgttgcccaggctggttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaaaaaaaaaaccaataaaaatacaaacagaaagtacaatataacaactgtcaacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtagatgagacttataatgaataaaaggaatcaatacagatttggagacggtggttgttgtcatagataatcttaattgcgttttcttctaaaacagatatgttgtcaccgaaggtcattacaagaagatgaagaaggattctcaaggtaaatattagtctggtgattttttttttcttctcttttgagacggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagagagggcacttgtctccttcaaggctgatggaaggtaggatatgtgagtccttcctcttaagtggcaggaaacagtattttctcttttatttcttttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaggaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtgagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatatgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatgaatgaaaattgtgattccgatgaagcctgccagagaaacaaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacactaaaaaggcaagagaagccctaagcagagtgagcaccagactccacaggttaagggctcagtcacacaggaccatccgcatgtcagaccccaggtgcaaggccaagcatcacctatgcatctgaccaactggctgtaaattggaggtccccacaactccctcctcaggtttgaacatttgctagaacagctcatggaacccaggaaaacagttttcttactagtgctgatttattacaaaggatattttaaaggacacaaatgatgaagccagttgaagagatacacagggtgaggtttggaagggtccttgtggagttggggtgcaccactctcctggaacatggatgtgttcgccaacccggaagctctccaagtcctgtcttttaaggagttttctggaggctttatcacgtaggcatgattgagctccagctctactccccacgccagaggatggggaatggggctgacagcacaacgcttccaaccataggtctttttggtgaccagtccccaaataaggagcccaccaagagtcacctcatgagaacaaaggacgcttctatcacccagaaaattccaagggatttaggagctctgtgtcaggaaccaggtttaaggaccaaatgttagaacaaaagatgtgcaaccataaaaaacagcgagatcatgtcttttgcaggaacacagatggagctagaggccattatcctcagcaaactaagacaggaacagaaaaccaaatactgtatgttcttttaagtgggagcaaaatgatgagaactcataaacaacagacactgggccctacctgagggtggagggtgggaggagggagaggagcagaaaaaactattgggtactaggcttggtacctgggtgatgaaataatctgtacaacaaacccccatgacacaagtttagctatataacgaacgtgcatatgtaccccctaacctaaaagaaaagtttaaaaaggaaaaaacacctaggagaaaagaaaaatgataaattaacaaaggacaatgctcttagcaccgccatcattcaggaatttccaagggttttaggagctttgtgttaggaactgggggcagagaccaaatatatatttcttcttatgttacactaccccagataggaaaacagaaattactctagatatttcaaacaaaaaagggttgtatataggcaattagtgcttatcactggaggtgctagaggtggtgaaggttgtggggatggggttgcaccactggctttcaggctactttaccacagctgatttccagaggatggaagaagtcaggaaacttgggaaaccgctgctgaggtccttgcagccccacggtccccaggctggtgactggtgggggagtatggagtccagctgaccaccagagcctgcacacctgctgctatgggggaggaaaggatgacttctacctcctttccacattccaaattccacgtgactacattttattggcagcaccccgctggcaagtgagccttgatgtgtgcttcctgggcttctggcacctgcacagaaaggggtgaaatgagtgtcacgagcagccaccactctgcatcacacctccacatccaggtgtgctggagagccccacttacacttggagtgtcctggtgccctacccacttttggtaggtgtttgggtgtctgaggctttgcaaaagaagaaggtggggagtctatggtggagtcacatggtggagacctagctaagtcagaggcctggagaggtgtcactggctgggcagcaggtaacacacaatcatcctgagctgattggagaaacacctgggattgattcagagttttttctggaatgttttcactggaatgaaagctgagcggtctgcaggccatatagtattggagaaaacttagccctcattgaaaaaggctgccagagaaaagatatccacagggaaattcaggagttttgtttgtttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattacaggcacccaccaccatgcccggccaattttttttttttttttttttctaaaaacagtttcaccatgttggccaggctagtcttgaactcctgacctcaagtgatccgctcaccttggcctcccaaagtgctgggattacaggcatgagtcactgtgccccgccaggaaattcagtttctgaaaatacacctgtggatctctagccttgaacacccttggatgctgctttaaatgactgatcctcgatgcctcccttctaactcacactcccctatatcaatctcccagaaaaagggacctcttttattcttttttttttttttttttttttttcagagacgggcctcactttgttgcccaggctggttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggcccggcgcctggggatgggaggcaggactgcaccttcacagggacgcttccaccctaccccggaggtcagggcctctcgcccagctctggctctgaggtcctggagggagggagatgctgttgcgactcagaagattgggggagggccacccccattcgagaagagtgaaaatcctgagcctgaagaagtggaaccggttggagccgaggctttagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactggcttacgacatgagagctcaatatgctccttatttaacgcactgttgtatcaggtccctgtgggagccactggctctatagcctaataaaggagcgggtgcacgcactggattggtgagctaccgccactgcaacgcgtcctaatcaaccatcctaaacggcggctggaacaaggttctcgcaggcctgtgcttgggcttgaacgctggtccagccgctgcgctctgtggctccctgtaggcctgcggatcggccagggggctccgttccttttgggcggaggctgaagaagcagcggctgcaccagagaaggccctctgggtgaaggtgggagcgcacggggcccgcggaaccacctaaggcgacttcagacgtgggctcggaactggcagcctttcgtttctgcttcattccaaggccagagcaagccacgtgggcaaacccaaagccaggggacaggaaagtatcctccacccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagcacatagtgctaagtatttggcttgtaatctgtagagactctgccatttggagctgggatctgtccccagagctgtcagacaccaaatcccgtatctactgccacccaaagggacctccagaagaaaggggttatacagggtcaaacaccaaggcaggttagtgaaatttctctagaggccatttaaagctggagtctcaccacctgaactgccctcagaggaaggctgtctagggcacaaacctagtcaggggtccacatggacttaaggacaatttttttttttttttttttttgagacagtctcattctgtcatcaaggctcgagtgcagtggtgtgaactcagctcactgcaagtctcaacctcctgggctcaggtgatcctcccacctcagcctcccgagtagcgggaaccacaggctcgtgccatgatgcccaattaattttcttttaaattttttgtagagatgaggtctccccgtgttgctcagtctaatcttgaactcctggactcaaatgatcctcctgcctctgctcctcaaagtcctgggactacaggtgtgagccaatgcacctggcctcttatgaataattttaaaaacaatgaggttcaccgtcagagcccctgctgctctaccaagtcccttggcccctctcaacagggcaaaagcaagatgagccccagatgttctgcttaatgaccacctttcccaggagactttgctctttaaaggagaaccacttagagatatgagcaaccttaaagaatgccaccagcactagtgaatgccaggcacgggccacgtgggtggagagtatactttagggcagtcactcatggtaaattatttccaccagcccccagaagtgactattcaatgtccaactatgtcaggcccaggctaataaaagtagaggcatgaggaacctagggttgttctgaagtgccttgattatggtacatgtggaagattttagagcttgttgtaaaaagtgatgacccatggccccccaggctgggtctgggattccctttgtggattacaagaggatattatacagcagtttttaaaaatgaggcagactgggacaatctatctccaagatgcataggtgctgttaagggaacaaagcaagatttagtagggcgtgtatagtatgctactgtgcgctgtgcgttatctgtacagaactgtgaggtctgatacagtagccactagccacatatggctatttacatataaatttaggttggccacagtggctcatgcctgtaatcctagcactttgggaggccaagtgggaggatagcttgaggccaatagttcaagaacaccctgggcaacatagtgaagccccttttctacaaaaaatttatttatttatttatttttattttttttgagacgggtctcactctgtcacccaggctggagtgcagtggcgcagtctcagcttattacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttaggaggctgaggtgggaggatttcttgagcccaggaggtcaaggttgcagtgacctatgactgcaccactgcactccagcctggacaacagagtgaggccctgtctcaaaaaataaataaataggagtttgaggccatgttcacacatcactgcagtccagtctggtaaacagagcaagacgctgagtctttaacaaaaaaaaaaaaaattttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaactggtaatggcggttgccttccgggagggaaactgggagagtgcagggctgtatgcccttttgtacctcttgaatttcatatcatgcgtttgtactaggtgtttacaaattattttaaaaacatactgggaattaggaatccccatatggaatcactgcagtgggacactgattcccaaaaaattactttgcaatttgcctaaaacaaattaagctaatagctatcatgatttcatatttaatattttttcacagcttagagtttttttagctcctgttgctatctctctgctcttatgagctcacagggtgacaaagtgaattagtaagtagcaggagaacattaaaggaaaaactcctgggcaacagggcaaaacgccggctctacagaaaatacaaaacattagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagatatgagccactgcatccaactttggttcttgtttgtctgttttgttttgttttggtttgtttttttgacagagttttgctgtgccacccaggcagtgactcagcctcggctcactgcagccttgaccttctggcctcgagtgatcctcccacctcagcgccaccccccactgccctccaatatctgggactacaggtgcgcgtgaccgcacacagctaatttttaaattttttgtagagatagggtttcactatgtggctcaggctggtctccaactcctggactaagcgatctgcctgccttggccacctcccaaagtgtgagccaccatgcccacccattgaacattgaagctagactgggcaaacccttaagcctaaaccagtaacagtttttcacaagttcatagatgttactgtggttaataacacacaaattcatttaaaagcatgtgtgtccacatagtaatttttggtccttatttttatttttatttttcagttaatggatattaaagatacaactttattttgttttttttgagacagggtctcactctgtcacccaggctggagtgcagtggcatgatcagagctcattgcaacctccacctcctgggttcaagagattctcctccctcagcttcctgagtagctgggattgcaggtacatgcaaccacacctggctaatttttgtactttttgtagagatagggttttaccatgttgctcaggctggttttgaactcctgagctcaagtgatccacctgcctcggcctcccaaactgctgggattacacaagtgagccaccacacccggcctaaagatataatttctatcatgaggaggtccaagaactattctctttttctttttttaatgttagaaagggattaactgggtatgtgctgcagcaaagggaggggaaattaagcaagaagagaagggagccaggaaataaaggccccaacccaggaagcagttaagcaaagttccaggatgacccatgtgacaagtttaggggataacttgagcacatggaggacagaacttggagagggcactgtgggcctgggcgccacctgctccgccagagcactggaagagaacgagggcacgataatggcagatggcactgaaagaaaaggagagagcttgaggcacccttgggggaagcagccatcatcagagtgtattttatttttattttattatattttgagatagagtctcactctgttgcccaggctggagtgcagtggcatgatctcggctcactgcaacctccacctcccaggttcaagtgattctctgcctcagcctcccaagtagctgagactacaggggggcaccaccacacccggctaatttttgtatttttagtagagatggggtttctccatgttggccaggttggtcttgaactcccgacctcaggtgatccgcccaccttggcctcccgaagtgctgggattacaggcgtgagccaccatgcctgacctcacagcacattattaagctctgtggtgaataatatttatatagtcacaattctgtaaacactgttcattttctacaaattgtggcaaacccaaacctcaagaatggacagggctagggtgtaaaagagctaagtccttgccaggtttaccaggaaggcaacagacagtgtctaaaactatgagacagctgggcgcggtggctcacgcctgtaatcccagcactttgggaggccgaggcgggtggatcacgtgaggtcaggagtttgagatcagccttgacaacatggtgaaaccccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaaggagaaaaatatttatccctaataactaatggaccatcttacgccgtctataaaaatatcaattaagaaatcacggccgggcacagtggctcacgtctgtaatcccagcactttgggaggccgaggcgggcaaatcacttgaggtcaggagtttaagactagcctggcaaacgtggtgaaaccccatctctactgaaaatataaacaaattagccaggcatggtgacgggcacctgtaatcccagctactcgggaggctgaggcaggagaattgcttgacccaggaggtggaggttgcagtgagccgagatcacaccacttcactccagcctgggtgacagcaagactccgcctcaaaaaacaacaacaacaacaaaaaacgcggtgatacacgcctataatcccagcactttgggaggccaaggcgggcggatcacaaggtcaagagatccaagaccatcctggccaacatggtaaaaccccatctctactaaaaatacaaaaattagctgggcatggcgcgcacctgtagtcccagctacttgggcggctgaagcaggagaatcgcttgaacctgggaggtggaggttgcagcgagccgagattgtgccactgcactccagcctggcgacaaagcgagactccgtctcaaaaaaataaaaaagaaatcagaaactgttcaaattccaatctatacaagtgaaacctacacagttaaatgtcttaatagagagctaaaagcattaagttctgtcatactcaacatactgatgaaaaaaatttgaactaaaagacagcctgatctttagaaactggcagaaaaaataggggctgcatccaagaccactcacggcacgtccattcttccagcagctcccaactgctattttatgaaaagtccaaatttcccaccccaaggtcctagagtacagccagctccctaccatcaaaaacaatagctaccaaaactcagtaaaattaggcttgttatgaagagaagattgaagaaataaaggtatttatttcatcttggtatttgaatgtggaaactcccagtagggtaagaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaactctctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctctcttctacaaactatatttcagggaaaccaaatatttgatgagggaattctttgtttagaaggattttagctaataaatgcagaggaataacaagatttaggaggggggagaaatcaccattttgtgacttctaataaaataatgggtctaggcaacagttttcaatggatgctaaaacgattaggtgaaaagttgatggagaattttaattcaggggaattaggctgataccatctgaaaccatttggcatcattaaaaatgtgacaacctggtggctgccagggaggaaggggagagggtgggggaagaacagaagttatagtttatgggcacaaagttttggttttacaagatgaaaatagttacagaaatgaatggtggtgatggttgcagaatattatgactgactatacacttaaaaatgtttaagatagagctgggtgcagtgttgcacacctgtagtcccagttatgcaggaggctgaggtaggagaaccacttgagcccatgagttcgagaccagtctgagtaacatatagagacctcatctcacaaaaacatcactaccacaaaacaaaacaaaacaaattgttaagatgctaaattttaagttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaaaactagccggacgtggtggctcacgcctatagtcccagctactcgggaggctaaggcaggagaatcacttgaacccaggaggctggggttgcagtgagccgagactgcaccactgcactccagcctggccaatagagggagactccgtctcaaaaaaaaaaaaaaaaagaaaagaaaacatagttacccagcaattccacttctaggcatatacccaaagaactcaaagcagggactcaaacagatacttggacatgaatcttcatagcaacactattcataatagacaaaaagcagaagcaactcaagagtccatcgatagatgaatggataaacaaaatgtggtatatccataaaatagaatatcattcagccataaaaggaattaagttctgatacatactacagcatagatgaaccttgaaaacattgtactaagtgaaagaggccaggcagctaaacttccaaagactaatatacaattccactgaataggcaaattcatagacagaggatagaataaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaagaataaacttgtaaattttatattatatatactttgccacaataaaaatttttttaaaaatgtctaagtgtgacaaccgaacttctgtgttaggataggaagaatacttatgaagtattcttgcccctgaaatgaaccaaaatctaatcaagtctctagaataaacaaccagttcacaggaaatccacagatagccaagcaagttagatggcactataataaagtaatcaaccaaatccagaatgtggaataagcagttaaaaaaaaaaaaaaaaagagggggggaggccaggcgaggtggctcacactatggtctcagcactttgggaggccaaggtgggcagatgcttgagcccaggagtttgagaccagattgggcaacatggtgaaaatccatctctataaaaagtacaaaaaaatttgctaggtgtgatggtatgcacctgtggtcccagctacctgggaggctgaagtcagacaatcgcttgactccaggaggcagaggttacagtgagccaagattgtgccactgcacgagaccctgtctccaaaaaaaaaaaggaaaaaaaaaggcatagagaaagaacaactgctgtagaataaaagactaaagaggcaaaacaacaaaatgcactgtgcgaactctgatccagatgcaaacaaagcagatgtagaaaagatgtagaaaggatactttttttttctcttttttttttttttttttgagatggagtctcgccctgtcgcccaggctggggtgcaatggcgcaatctcggctcactgcaacctccgcctcctgggttcaagagaatctcctgtctcagcctcccgagtagctgggattacaggcatgcaccaccaagcctggctaattttttttgcatatttttagtagagacagggtttcaccatgttggccaggctggtctccaactcctgacctcaggtgatccaccagccttggcttcccaaagtgctgggattacaggtgtaagccaccacactcagccaggatacatttgatacaactggagaaattagaataaggactaggtgctagatattaaagaattattattaattttggagatgttataatagcatgaagattttatatatatatatatgccttatcagttggaaatgaacactaaaggacatgtgaataaaaggcatcatgtctgggatgggcaaaatgcttataactgttgaggcttggtgatgggtacatgggggttcgttatgttatcctctctgtctttgtatttgttttagattttccactaaaaaagttaaaaaaataaatgcactactttgagaaaaaacattctaaaatctatagcctggaaaagataactgcaaatagagttaattgccaaaggtaacagctaaaacaatgatataaaatataaagggacagtcgacttgggtatttcatctggaaagactgacgaatatgtaagtctttactatcaagtacatgcaggagaatctccaaaacaaacagactccaaataaattctaaaatgagaaatttgtagattccatatggttaatattttacatgaaaatcggggtgtaaaaactatagtcagccctctgtatccacagattcaacccaccttgaaccaaaaatattaaaaagtaataacgcaagccggacacggtggctcacgcctataatcccagaactttgggaggccgaggcgggtggatcacctgaggtcgggagttcgagaccagcctgaccaacatggagaaaccccgtctctactaaaaatacaaaattagccgggcgtggtggtgcatgcctgtaatcccagctactcaggaggctgaggcaggagaaccacttgaacccgggaggcggaggttgtggttagccgagatcgcgccattgcactccagcctaggcaacaagagtgaaactccgtctcaaaaaataaataaataagtaaataaataaaaataataacgcaacagtaaaaaaaaaaaatacaaataatacagtctaactatatagcatttacatgctagtagacataagaagtaatctagtagtgatttaaagtagacaggggggctgggcacagtggctcacgcctataagcccagcactttgggaggccaaggtgagcgaatcacctgagatcagaagttcgagaccagcctgaccaacatggtgaaaccccatctctactaaaaatacaaaaattggccaggcgtggtggtgcatgcctgtaaccccagctacttgggaggctgaggcagaagaaccacttgaacctgggaggcggaggttgcagggaggcaagatcacaccactgcactccagcctgggcaacagggcaagactctgtctcacaaaagaaacctccccagtaagtataaagagaccctaagagaggaaatggctgacagtgtaaatagagcagagcaccagaaggtatcacttcaagcatccgtctttagagacatttcacagaaacagtatcgaggctacaaaccgaataatctttaccttttgtgttctggaaaaaatgctgccacagaggtctgattttgaagtggctgccaacatcccagacagcgaaggtgttatttttatattctactgtctccacacagaaacctaaatgaaacatggggaaaacatttaattatgatttgtgctggttgaacaattcaaaataatttcaacatgcggacagtacttttaatttacaaagcagcctgctagtcaaagatctatagccttcaaacagaatgtgctggccccctcgcccattcatcaggacaggtgtctcaaaccttctctactctccaatctctagccacgcacctgccctttctctcagcaggagactatcacagtgtacttcagagcagagaagccgccgatgggaatgacttccacttccaccatacagtgtaaaagccagtctacatctttacccatgcttttcttcctccctcttggaacaacagaagaaggtaactctcttccaccaactccctccctctatgagccagatccaccctacccagactgtctggaactttttactattcctattctctcccatatctgaatatctccaatctgttcaccttggcatgcttaagccttttacatctttaaaaacaacaaaacaaacctttccttgatccccacatcttcatcgcactctcttccttcacatcttcaccctctatttgctttttttttttttaagagacagggccttgctgtgttggccaggctggagcacagaggtacaatcatagctcactgcagcctcaaactcctgtgctcaagggatcctcctgcttcagcctcccaagcagctagaactataagcatgagccaccatacctagctaaatttaaaaaattttttgtagacacagggtctcactatgttgctcagattggtctaaaactcctgaggtcaagcaacctgtccactaagctttcttcggtcctctcacgcaacagcaccttagctctgctccaccattgggtagctggttttcagtaaggtcagcagtgatcaccaggtcaataaatctaacacaggccttctcagttcttccataatttgatcttctatctgacgctactgctcactccctccttgacacccttccccagcttcccttttccttctatctctatggctgtactgtctcagtctccttagtgaactcagccacgtttaactgatcctgcaatgatgggagtcgccctggctctcactggccccatccactctcctctttctgcacccctccctaggcaatctcactcactcccacgacttcattcctatctctgtactaactctgagatttatatcccccaacctagccctctctcctgagcttcaggctcataatctaacagctttggcaaatgtcttcaaggccccaaaacaaggtgatcagtcaaaaatggaatttaaggtccctacccccaacctcctcctctgctagttatcccatcattgacttcgttccacaagctgatagcctgagaggtgccctggaaacatccgatgctcgcacccctagaaccctactaccacaccttatcaattcaaccccttcaacaactaatagtcaccctaacccaacagaccatcatttctagcctcaattcctgaaaccatataactaatttcacctcagccactctccctctctccatccggtcaccatcttctaaacaaagcaatagcttaaaaacacatagtgtggtcacgtcatttctctacacatttatgtttgattggaatattttcaaacttaaaaaagaaagaataatcgccccaaaaaataaaattaaaaattaaaaaaaaaagaaagaataagccgagcacagtagctcacacctgtaaccccagcactttgggaggctgaggtgggcagattgctttgagctcaggagtttgagaccagcctgggcaacatggtgaaaccctgtctctacaaaaaaacacaaagattagccaggcattggtgccgtgtgcctacagtcccagctacttgggaggctgagacaggagaactgcttgaagcaaacattgcagtgagctgagatcacaccaccgcaccccagcctggatgacagaataacatccaagaaagaaaagaaagaaaagaggaagagagagacagagagagagagacagagatgggaggggaggggaggggaggaaggaaaggacagaaaagggagggagggagggagggagggaggaagggaggaagggaggaagggaggaaaggaaaagaaggaaagatgtccccttagcggcttcccacacccaaatcccaaacatgactgtcaagacccaagcaagctgggtctgctcaccttccaaacctcaattctagtcatgccttattttagtgagagacactcgttacattgcaacaatctaaattcttgctaaataaataaatacaatgccattccaatcctataatgatggtaggggcaggggcaggaaacttagcaaaattatctaaaatttaacctggagaaataaacaagtaagcataaccaggaaatctctgaaaatgagtaatgaattatttttaaggatatgccaagccctagtaacacttgaatagagttcaaatataaatgcaacaggtacttgcccaaaaaaagacacacataccagtgagaatttagtatgtaacaaagaaggcatttcaaatcagcatggaaaaattattcaataaatgacattgaacaactgtctaccccagcaccgtccaatacatagtcactagccatttgtgactatttgtttatgtttttgttttattttgttttgtttttgagacagagtctcgctcttgtcacccaggctggagtgtatggtgcgatctcggctcactgaaacctccgcctcccggattcaagtgattctgctgcctcagcctcccaagtagctgggattacaggcgcctgccaccacgcccattttgcaattttagtagagacggggtttcaccatgttggccaggctggtctcgaactcctgacctcaggtaacccgcctgcctcagcctcccaaagtgctgagattacaggcgtgagccaccatgcccggcctatttatttattttttgagacacagtcttgctctgtaacctaggttgaagtgcagtggtgcaatatcagctcactgcaacctgtgcctcccgggctgaagtgattctcctgccttaacctcccgagtagctgggattacaggtgcatgccactactaatttttgtatttttagtagatatggggtttcaccacgttggccacgctgatctcgaactcctggtctcaagtgatcttcccacctcaacctcccaaagtgctgggattataggcataagccactgcgcctggcaacgtggctatttaaacttaaagttaaaatcaaaaatcaatcaataaataaaaataaataaaaaataaacttaaagttaaatacaattaaaagttcagttcccggctggacacagtggctcatgcctgtaatcccaacactctggggggccaaggtggacggatcacccgaggtcaggagttcgagaccagcctggccaacagggtaaaactccgtctccactaataatacaaaaattagccgggtgtggtggcgtgcacctctaatcccagcttctcaggatgctgaggcagaagaatgacttgaacccagggggcggatgttgcagtgatctgagatcgcgccactgcactccagcctgggtgacagagcaagattccatctcaaaaaacaaaaaagttcagttcctcagttgcattagccacatttcaagcacatgaacagtcacatggctattggctacgacactaaacagcacagacacagaacattttaatcactgcagaaagtgcctcctgggcagcactggcttatccatttgaaaaatttaaccaaattactaccttacacacaaccatctcataactcgaacattctcctcggtttcccactcctcaatcgatgcaatctctgcagctactgcccaagttgaaagttgatcatttggagaccaggtgcggtggctcacgcctgtaatcccagcacttagccgggcagatcatttgaggtcaggagttccagaccagcctgcccaacatggtgaaaccctgtctctaccacaaatacaaaaattagccttgcatggtggtgaacgtctgtaattccacctactcaggaggctgaggcatgagaatcgcctgaacccaggaggcggaggttgtagtgagccgagatcgcgccactgtacttcagcctggggtgacagagcgagactctatctcaaaaaaaaaaaaaaagaaagttgatcatttgagtcctgtgcctaattcaatattcagaacagaacagtagtaatgttcacatgccacctgtggggtgtatcctcagtcagaagtttggatctagaggcagttcacaaggcaaagattcagttctgtcaaaactcgctttgtaaatctcttaacaagccggtaaaacacagtgctggttcacagtaagagcagtgcagccagcttgtctatttctctagttggacatcatctcaagcagttggtttgagccagagtgaagaaaagaaatcacactccatctctaagcactgggagcgtacttggtgtagagatgagatgctgccactaaggaaggccagctggaacagaggctgactgaggaggcaccagcagattcccagctcccacctcagccttctgctgggacactagctgcgaggaatgaggggcagaactaccctccctgttttgcccattatctttttcttttttgccaagcaaatggggttaaatttgcttagcctccatgtgttcacatgtctcccttgtgaacctaagaatgtgcaagccactagaaaaggatacataacctggccaggcgcggaggctcatgcctgtaatcccagcactttgggaaaccatggcgggaggatcgcttgagcccaggagttcaagaccagcctaggcaacatggcaaaaccccgtctctactaaaaatacaaaaattagctgggcatgctggtgcacgcctgtagttccagctactcaggagggagatggaaggatcacttgagcccaggaagttgagactgcagtgagcagagatgtaccactgcactccagcctgggtgacagagtcaaaaaaaaaagaaaaggatatatataacctggtttttggcctctaaaaatgtatgctcatggagtagacaagatttttaaaaagaattattcaataacataagaagcatgtaaaaataaaacatatttctctggtgaaacagaacctaaaaaatatatataacatactaaattgtaaactggaattgccacaggtctttcattaacttacctactgtagggacggcaggcacagtctcccccagcttcaatttatacaagatggtggtttttccagctgtatccaaactcaatataagaatccgcatcttttttttcccaagtagacttttaaagagcttttcaaaaatgtttcccattgtaatttaatcgaattctgtaacatgacaagaaaagcaagccaaataattgttctctgcagagatatagaagcaacacgcagaaaatacaagtgtcaattagaaatggctcccaggaaaaattcaacaattttaggtacactttggccaatgagtagtgagtcttgtcttcaaagggaaactcaactaaacctttccatgccttaccagaaaattctattttccactgcagcatccaagagggatatgcaacatagcctcagcactgctatgacagtggcagcctttagtcatttagtacagaagtacaaggccaggtgcggtagctcacgcctgtaatcccagcactttgggaggccaaggtgggtggatcacctgaggtcatgggttcaagaccagcctggccaacatggtgaaaccccgtctctactaaaaacacaaaaattagctgggcacggtggtgcacgcctgtagtaccagctactcaggatgctaaggcataggaatcacttgaacctggggaggcagaggttgcagtaagccaggaccacgccactgcactctagtctgggcaacagagcaagactgtctcaaaaaattaattaattaattaattttttttaaaaaacaagtacagaagcaatgatacaacaaatacaactatacctcattctaaattctactgaaatgagaatttatgaaacagagaagctttttattttatgcaatataaaacaaagtctttaagacaggttaaacaacaatatcccttggaaacgtagtagttccttatggctagcagacaccttggaaataacctaagaaatttcagaggcaaagaaattcagcgttgggaagcttcactgccaagagagataacttggcagagttgaggaggcaccacagcatccagttttcgtttgagttttttgttttgttttgagacagggtctcgctctgtcacccaggctggagtgcagtggcacaatcacggctcactgcaacctcaacctccccatctcaaacaatcctcccacctcagcctctggagcagctgcgaccacaggcatacgccacctcgctcagctaatttttgtattttttgtggaaatgaggtctcactatatttcccaggctaatctcgaacccctgggctcaagtgatcttcccacctcagcctcccaaagtgctgggattacaggcgtgagctaccaggcccagccagtatccagtgttctattgctgtaactatcaccttactctcaaccagttcttagaactttttatttaagtataatttacatacagatataaacatacatgataactgtaaagttcaatacattttcatgaaccaaacacacctatgtaaccaaatcaagaaaagatgatttatcaggctgggcacagtggctcatgcctgtaatcccaacactttgggagaccaaggtgggtggatcacctgaggtcaagagttcgagaccagcctggccaaaatggtgaaaccccgtctctactaaaaatacaaaaattagctaggtgtagtggcacacacatgcagtcccagctactcagaaggctaaggcacaagaatcacttgaacctgggaggtggaggttgaagtgagccaagattgggccactgaactccagcccagggcaacagagtgagactccatctcaaaaaaaaaaaaaaaaaaaaatgattatcagaccaattctccttgtgcctcctcccagtcattactccataaaaggtaatcactatattgacttctaacagcataaatgttcaatattttatttttcagtagaaatcatggtaggttatataaagtaagtcaatagtaaagtcagactaacttacagaaatttacagtctctttgagatcagcctacttgaaatgtgagcttgacattctaagtaaagacttacaagcagtgctgggtctacacctctaactaagctcttggaagtctgtaaagatcttcagaccaggcagggtggcttacccctgtaattccagcactttgggaggctgaggcaagagggtcactttagtttttgcttactgagataacagaagacaagggaggattgctttaggccaggagtacaagaccagcctgggcaacatagcgagaccctgcctctatttttaaaaataataaaacaaaaaaaaattcaaaaagaaaaagacatacatccttgttccagagactgtgatttattttctttttaaattgctaaccaaagaaagctttactcctgggcaggggaggaggaagacacaaggaggatagccaatctcccattcattcggactctggtaaccacagagcggaggtaaccaaattccacaggcctcaccgctgaaattcaacagtggccagcagtagcttaatatcatggattacgcccaagtacacaacattcctttctaggatgagagaaagcgagcacagaatttatcctgttcacaaatgtggcgtaagtgaccaaagaatgataaatgttttaatcattcaaagaaagtccattataggtctataaaagtccagtgcattgcagcactcaaaatcttgccgggcgacaaaactagagattccttttctttgtttcgaaaaacaaatctcacagatgaggagacttttcaggaacatgctgggggagggaaggtacttcccgctcagatgccccttgaggcagctagtcccaattccccctgccaaccgcacagacacaccaccttgacctccctctcccttctctttcctcttattgctactcatgtgccccaggcgcccgtggtcctgacacccctgcgccgctggagacccctctaaggtaagatggctccgactacagggcctttttggcacgctcagtctcccagccccaagcgccaaaagtgcattagggagaaacgtcggcacgacgtcaagggcgcgaacaagcgtggtggcccaggtgagcgtgcgcggcagccaggcacgcccggctcccggggaaagacgccccttttttgccccggctgccaggccgctccttctcaacttgtgcgcccctggaagagcaaagagagggccctgcgtggaacctatgaagcctccttcggttcctcgctgctccggccctagagagggcgaagaaggaacagcggagcccaatccctttccgaaagccaccgccgccctccagtttctggcccgcagacgaagtggagatccagccaggtcttgagtgctgccgccccatccctgcagccggagactcacctgttgccactcaaggtaccgctacctacaacaccgccgactccgcggcctttaggatttcagctcagttcagctaaaccacgacaggcgtgggggcaggaacagcaaccaaccaatcacccaccgcctcctggagcttttgcaccaatgagctcgaagttttgtgagtgacgacatatctggccaacgcaaagaagagtaagggcctgggagggagggagcgccgtaggcgacgccatgaagctctggcaataccatgttcatcttcaaatcacagttaaacgaattctggcgagacacgcccacgtcccccacccccgatgccatgtgcgaccaatcagaaaagcaaaaggattgtctatttgcacggccaatcagctgggaaaatcgccgaggtttgagctaacctcggagcgttcacaccaaccgggaggggacatgtgggccgggccaagttaatagtgccatggaaggaaatttaccgcggttgagttaaacgtagacattagtttggggcggtgttccgcgtaggaaataccacacactgacactgaaattaggcataaggaagttttcctattccgcctgaggctagactgccctcccacctctacacagattttcaagttggggaaaatactggccacccgcacctcgttaagacgtcgcagaaccagtcctcgtttccgagaaatgctttctatagtcagttccctaaatgcccaacttgttagctaaaaaggttacaaacgcctgtaaatggtacataactgaaatcatcagaacaacaaacatctattaaacatatactatgtgccagaaactatatcaagaacttcagcaggcccggcgcggtagctcacgcctggaaggccaaggctttgagctaggagttcgagaccagcctgagcaacatggcaaaaccccatctctgcaaaaaaaaacaaatttaaaattagccgggcatggtagcggctgtagtcccagctactcgggaggctgaggcaggaggatcacttgagcccaggaggtagaggctgcagagagccgtgatcacgccactgcactccagcctgggtgacaaagcgagaccctgtctcaaaaaacacgaacaaaaaaagttagaagatactgctagaattgactaaataaataaataaataaataagaaaaacaatgttacctgcaggaccgtaacgcccagtgaattacaaactattatccctggccagacgtggtggctcacacctgtaattccagcacactgggaggccgaggcgagcagatcacctgaggttgggagttcgagaccagcctgaccaacatggagaaaccccatctctactaaaaatataaaattagccgggcgtggtggcacacgcctgtaatcccagctacttgggaggctgagacaggagaattgcctgaacctgagaggcagaggttgcagtgagccaacatcgtgccactgcactccagcctagacgataaagcaagaccctgtctcaaaaaaaaagaaagaaaagaaactattatccctgctgttttacagaaaaatattaagtagcctgggtctgtcccactcccacaccttaatctttttctttctttttccttttttttttttttttgagacagggtctcactgtcgcccaggctggagtgcagtggtgcgatctcggctcgctgcaacctttgcttcccaggttcaagtgatcctcctgcctcagcctcacaagtagctggcattacaggcatgtgccactgcgcctgcctaatttttgtatttttagtagagacagggtttcaccatgttggccaggctggtcttgaactcctggcttcaagtgatccacccacctcagcctcgcaaagtgctgggattacaggcatgagccaccgagcctggccaccttaatctttttaagcaaatacagaatggaaactgccctcacaggattaaggagagttacaagccaggctttaggcagcattatatatagttagctgttatccagggtgcacaagtgtactttgacccacttccctgcagctgctaactcactgaacatcactccacgtgctagaccacctcctacctgtttctccatggttcttaccatgagtaagaatttctgacgctagactcataagatcgttttgcccaagaacgggttgtttttcagatcctgaattctgacgtccccaaccaaggaacccactcagcacaagaatgaggtttcttggtctccctgtctcatgacttcgcccttcacttcttgaccaatcatcgatccccacactgcagcccctgtccagaggacttaaaaaccctgccccccaaacctctcagggaggtggatttgaggcttcttcccatctcctcattcagatgccctgtgattattaaactctttctttgctgcagccaggtgtctctgtatgctgactcactgtgcattgagcaaacaaaactattaaattacagtactacttactcttctaattacagtgcttatatgtatgagggttaatataaatacatatgactccttaaaaattaaagtatgttttttctgactataaaaattatacataaccgggtgcagtggctcacacctgtaatcccagcactttgggaggccgaggcgggcagatcatgaggttagatcaagaccatcatggccaacatgctgaaaccccgtctctactaaaaatacaaaaattagctgggcgtggtggtgcattcctgtaatcccagctacttgggaggctgaggcaggagaattgcttgaacccgggaggcggaggttgcagtgagccgagatagagccactgcactgggtgcagagcctgggtgacagagtgagactctgtctcaaacaacaacaacaacaacaaaaaactcatgctagtttaattttcatttatttgatgacttgctatttttccaaatgtttactagtatttttatttcatctattagaaatgatatattcatgtcctactgacttccaagggaaagatagaaagttgttttgccaggaactatgaaggttgtttgaatggagtcatcataacctaaaaaaaaggtgaaataacgaaggtgagatttttacttaccattgtttgttcctacagaaggaatgctggagctgataattatgagaatttatccttccatccctcatagcctaagaatattcattattttcccaatatctgcactgagcctgtaaaccaaaatgtatctgagacatgtctcaatcaatttacaagtttattttgccaaaattaaggatgcttacctgggagacaggcctgtgcctttttccaaaggtgattttgagggatttagtttggtttgtttgtttgtttttgagccagagtctcactctgttgcccagggtggagtgcagtggtacaatcttggctcgctgcaacctccacctcccaggttcaaatgattctcatgcctcagcctcccaagtagctgggattaacaggcgcgtgccaccacttctggctaatttttgtgtttttagtagagacggggtttcaccatgttagctaggttggtctccaactcctgacctcaggtgatccgcccacctcagcctcccaaagtgctgagattacaggtgtgagtcaccgcgcccggccagaaggatttaagattttatttatttatttatttatttatttttatttttgagacagagtcttgctctgtcacccaggctggagtgcggtggcacaacctcggctcactgcaacctccgcctcctgggttcaagccattctcctggctcagccgccccagtagctgggattacaggcgcacaccaccatgcccagctaatttttgttgtttttagtagagacggggtttcaccatgttggccaggctcgtctcgaactcctgaccttatgatccacctacctcggcctcccaaagtgctgggattacaggcgtgagccacggtgcccagcaaggatttaatatttaaaatggaaaagcaggctggaagggaaagaaggagagtatggtcacattactgaattcacatgttgcaagagacaaggagcaagtaggggaatagtcaattatgtattactctcgtgcttaccataagataaggtggacatagagtagttagctgcagtcagtcctgcttaggaatgaaaggaaaggcaacttcttgcatgactcagctttcagcttaaatttttttcttttggcagaatgaattgggttcccaagtttttattttcctttcacaagcctctgaataaacaaagttcctgcccacatggcattcaattgctaaacaattataatcacataaatacatacacatatacgtatatgttttatatatatatatatatataatatatatttaatacatacgtccgggtgcagtggctcacacctgtaatcctagcactttgggaggctgagttgggtagactgcttgagccaaggagttcaagcccagcctggtcaacatggtgagaccccatctctacaaaaaatacaaaatacaaaaattagctggtcatggtggtgtgcacctgtagccccagctactcagaagactgagatgagaggactgcttgagcctggaaggcagaggttgcagtgagccaagatagtgccactgcactccagcctaggagacaaagtgagactctgtctcaaaaaacaaacaaacaaaatacattcatatagagagagaaaaagagggagaattttataatgatatgcatgaggaatgtataggggaagaggctaaaaataggccgaacttactagtgaatatattcaggaggtaggactgtgattgtttttaagtgatcgagggaaaatagtgtactgattttaaaatggaaaactcaacttattttttaaaaattaaaactctgacaagagggaggtttaattgaaatcacagtggctgctcagggaagtttataaatctcgaactgcaacgactcaataagcatgaattgcttgtgatgatattgacttaatagagttattttttccttaatagaaaacacatcttatcaatataatgttatttgtaaagcatggaaaggacaaagtgctcttgggagaagtagaaagagaatttcactctgagaaacctatttggagaaagctcctcatctctggcttagactttaaaattagttaatagtgtaattagggatagttgtagtaatagtggtattggtatggtagttagagtttaaatgtcacacagaatacccagaccaccttcccccaagtgccactaaacttattcttctaatcaaacctctgctcaagggatgtcttcttcctctcttggaaagctgtgttccttacctcagaaacagccctccataaacctgcccttaagagaatccttggccaggcacagtgattcacgcttgtaatcccagcactttgggaggccaaggcgggtggatctcttgaggtcaggagttcgagagctgtctggccatcatggtgaaaccctgtctctaccaaaaaataaacattaaaaataaaaaaattagccaggtatggtggtgcgtgcgtgtaaatctcaactacttgagaggctgaagcaggagaattgcttgaacctgggaggcagaggttgcagtgagctgagatcgttccactgcactccagcctgggcaacagagcaagactccatctcgaaaaaaaaaaaaaaagagagagagagagaatccttaagacatgccttcttggatgccctctggagaaatgtcaagagtagccaatatagtcaccccagtcggctgtggtgtgtgggcctctagtgttttaaggttctaggcaacttagcccctcccaggagatgctgatttacttttctcaaggtgcataaagtctcatcacaccaatatctgaaaaatctcttttcaaagagatgcaggcagccttccagccccatgatgttaatacacagggttaggcagcctggcaagtgcactggggcccccactgaaggatcatctggtttccatagcaacagtccttcctttccacggaggattctatcatctctcctgctcactcaggctttccagaatgaattgttttttgtgactataggtgtttgtccttgatcctgcaaagagaaaagacatattcatttaaaacaaacaccccccaccccgccccgcaactgactgcagctagaatactgcattgcatcagctggtcttcctttcatttaaaaattccatgtcctttctccattttgctccgttctctagctttatccatcattttagaaaacaggtttctctgacagaaaacaaacagatggcaactccatcatcctaaaactggctgtgacggggctctaaaattaagtgttcatggggctcccagaaagcctaggcttgcatggtatgtgtggctgacctgtgagttacgattggaggggcaagagaaggctttctatacacagatggctccccatacagtgtcacagtctctgaagtgttgccttttgaggtttgttttcttaggtcaggcactgctgtcctgtcagtattttcctaaattgccaatactcctgggaagagtaatacgttaggttactaatactgaaagaacttgggaaagagaggagggggtgcagcgggaagggaataaaaggggctctgaagaccacctttgtgtgcttcacagtgacatcttctgcaagaggggaagtgcaggtcttcatctctctctttgtctctctctgtcacacacacacacacacacacacacacactgcaggacgccttctgacaattacaatacagtagtgaattcaccgaacaggactgttccctgaaacacctacatacaatcccgctggaagacctttgaaacagccctgcagtgactaaaaactctgtccccagtgccacttgtttaaccctacagtttccacagactaaaggtagttttcctttggttaatatgaaaacaccaaatagtcagattgctttgttaaataaagtggattacggtgaatctgttcacttctatgttttatattgccctcactccacaaatcacagaagatatttatttttcccccagttaaattctgttaccacaaccattacaaacaaatgtctatataaccaaaatgttagtcagccccattccaatggagcacattttaagtgatgtttaatgggacataatttgaacataaaattctatctgtgcactgttttcaagtctttgaatcaggcctccacctatagatgttggttacctatcagggagcaacaggtgatgctaaggatcactttgtaaaaaccaggaatcacatccctgtaactgacaggaaactgactatattcatcagggttctccagaaaaatagaactaacagaatgtgtatatacataggaggaaattttgtttaaggaattgactcgtgtgatcgtggagactttgggagcccaaaatctgatgggagaagctggcatgcaggaggcccagggaagagttacagttctagtccacaggtaacctgctagagaattccttcttgttctggatgagtttggccttttgtctattcaggctttcaagtgattggatgaggcccacctacattatggagggcaaccttctttactcaaagtctacagatttaaatgtaaatctcatccaaaaacaccctcacagaaacatccagaataatatttgatcaagtatctgggcaacatggccaagccaagttgacacagaattaaccgtcacactggatcacaagggctgtgttcagcaagaactgaccttggtcaaaccctgcccctgcccttatgccccactcttcttcattctgggtcctgctatttccattttatcatgtcttcatcttctttccccacctttcaggtacctttcctctctgaccctatccctagactcacctcctaccccccactcaaagcccttccttccttaaaaaatgatgttagtcattacactttaggatttaaattaatcattctgttagccgtcttactaactttctcactgtgaaaggaaagcatattaaaagaatttcagggatcgacgaagagctgagggaggtatttttctaggaagagaaagtgactaacagaaatcaagacaaagggggacaatcagatttttcagatgacagaaagcaggtaaactctagagatctagagaactagcaaatggtctcttcagggtgtcatcattgcagtaaatgagctctagctatttctgtctttattcttcagggtattcaagattgcagttacttaggagagacagagcatctgactgattgaacttgggttctgtattcactcctgggccagggggaggcagggtacctggtctgacagtccttccaaggctgcatgaaccagaggagctgttaccagaaaagggcagagtgaatttggggcagcaaaaacatttattgcttatcgactatcactgcaaggattactcagagggtgatgcagaatcagcacccctctatttctaagatgaccttgaatgtcagagcaaggcacaaacaggttgcagagacatgtggagtatctggagcactgtctcaggatccttcctctcctgctggatgctaaggaccttaaggacaagagctatctttgcttgcaatttatttggcaggccctgcagggctgtgcaaatgattctatttaatttttactacttgtgagaaggcacagagggctttgagagggcacagagggcctcttataatgggtagatatgcacattagctgatacactggaaactttccagcaggcatatccttccaagatgataaatattcttccttgttggagaaattgaagacatttgtacttgcaatctagcttatctagtaaaacaagacaaactaaccagtgatagggagaaacatgtttgcattattttccaaccttgaaaataatgtcagattattggactgagaaccaatgtcatcttctggatctggtaattatttggacaaaatctctttgattctaggttcaaagtcaaggtgtcaaaaaaaaaaaaaaggatacaactgttaagcttatttaattatacctctcactgtacaaataaggaaactaggccaggcgtggtggctcacttctgtaatcccagcactttgggaggacaaggccagtggatcacctgaggtcaagagttcgagaccagcctggacaacatggcaaaaccctgtctctactaaaaatacaaaaattagctgggtgtggtggcaggcgcctgtaataccagcgacttgggaggctgagacaggagaatagctagaacccgggaggcggaggttgcagtgagccgagatcatgccactgtgctccagcctgggtgacagagtaagactgcgtctcaaaaacaaacaaacaaaaacaaataaggaaactgggctcagagagatgaaggtacacaggtgatgggtagatagggacaaagaaaagaacctaaccctttggactccccaagccattctaatatttgtttttgtaagttagtagcttctgcacgttagtatgtcagaactcaactagtttcctatctttcctgataacctctccgacccacccatgatttagctaacatctgatttggtcaaccaagcaccctggtcctcaggttcagtgtgagacttaatgaaataggcgtgaatttttttttttttttttttttttttagacggagtctcgctctgttgcccagcctcgcaatctcaactcacttcaacctctgcctccggggttcaagcgattctcccacctcagcctcctgagtagctgagatcacaggcgcccgccaccacgcccggctaatttttgtatttttagtagagacggggtttcactatattggccaggccggtctggaactcctgaccttaggtgatccacccaaagtgcttggattacaggcatgagccaccgcgcctggctggcatgaattttttcttctgtccctagttcatcttcaggtcactgtctgattttattagttctcaaatttaaatcactatgcatgctcagctcttctagttatttcccttctttcctcatgttgggaaaaaaaccccgatttattctaattgtgagaaatgaaagcgaacaaatcctatcattccctattgtcttgtgcaaatatgaagagagatatgatagtggggtaaataaaagcatcagggaatccattcggcagaatctttctcctctcagcgtgcttgcagttagatattctgagattccagtggagaaatggtatggtggaaacattgaggttcaacaaggctcaatttagggcatattttattcagattctaccatatatattgtctaaaatgaaacaacactggggaatgaaaaggttggtcgaagatgcaagttgcctttattaaataaagacaaatatttaataaaaataatgtataaaaataatcacaattcactttcaaatctgaaaatactgagttttccaggctacacataaataaaactgccaacgatgacaattccagcaactaggaaaacaagtacgcctacaaagaaaagtgagaaaattcatggagaatttgaactcagaaccaactcctcggagctgatcttttttgggggaagccagggaacgcgccgggcgctctcatcagcaagaccatgtttaaagagagtgtggaagcacagaccaaaatggacattcgagggcgaacagcagctggcaaagggataagtgatccgaagcattaaagcccttgagacaaattccggcgcgaaccgccagtgggggatgagactcgcaggcgcagccctccaggccccggcggactgacacgcacgttggaaacggagtcacccaccacagccccgcagctccagccaaaatggcgccgccgctctgcccaccccgcgcaccccaggcggccgccgagcccgcgcgcgcgccctgtggagcgaggacgccggggacgcggccagggacgcgcgcgtcctcacggcggttgcacgcctgcgcgagggcgggcggcgggggcgcgcgcgcggcgggggcgggctttgccgagcgcagagctgcagccgccgagccggacgtgtccgcgaagatggcgggccgggtgagtgccggtctgggagcccaggcttgaggcaggggcgccgggctcgcgggcactctggggtccaggcggccccagaggagtgggagtgaatccgagcaatggggcgcgaggccagagcgggacttgagggtagcaggggagcggtggcaggggattagccctcctcaacaactccacccccctcgaggggagatgacccctcgttacacgcgtctgctgcgcctcccgtcatcctcccttcccatcccttggggcttgttccctcgtcctccacacagccgcagggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaaggtcgttgggaaagaggagggggtgccaatgacttttagtgttaaagcccggccatctgggggacctgtcaactgtcgggtcaggcaggaattggctttagcttggagtgaggatggatttggggtgtcacgttttgtttttatggatgacactcgcttcgaatgcagcaggatatgctgtagtttcagggttttaaatttacttcctcctttagcctttaggatcgttgggtaggatgggtttggcgaggagagagagctggttgagtgctgtattgcagtctgccttgagctaaaagctctcaagggatgagtcctgcccggagattacactggtcataaacctgaggacattaactgcgtcattgggggtgaaagatgtgattgactgatctatttataacagaatttttgaataagtttgcatagatttatgcatatatgcaaatgccctatctgaagggacttgtaggtcatgagattctagagtaagaagggatcttaaaggtcatttagtttggcttctttctcttccttttccccatggcctctccttttaaggctagtccttctgccagtacttcagaccctatctgtatattcacctgctccttcttaacataatcaagcttctctatcttaaacccttcccccacccccacagctgtcaccttttcccgtcccagtttacagcaggaaatttgatagagttgtctatatttattgtcttccatttgcttaccacctactcacccttcaacctactgcagtctgatttctgccccatcatcccactgaaacctgtccctcaacttaattgatacctttcaatccttatcttatttgatatctcagcagcgtttgacgttgttgaccatggcttccttgacggaaagcactcttcacatgtgttctggaatgcctcgctcctggtttgactcagacctctcttttgcggcctcaccctcctctactttgttattcattgctggtattcctcaaaggccgtcttctcactctcaatttcccgctcaggcaatttcttctaagcccatagctacaactgtctatatgccagtgattctcaatattttacccccagtccagacctgccctttaagtttcaggttaatatgtccaactgcttatttaaaatcaaggtcccgaaacgcagctttttcaactccgaacccaggatcttagcccacctaacttgtgtagatactcctcgacttaacgatggggctaccttccgataaacccattgtaagctgaaagtatcagaagttgaaaatgcatttaatacacccgatctaccgaatatcatagcttagcctagcctgccttccttacacatgcacagaacacttacattagcctacagttgggcaaaatcatctaacataaacctatattataaaatgttgaatacctcatgtcatttattactgtgctgatagtgaaaaacagaatggttgtgtaggtcttcaaagtacagtttctgctgaatgcctatcacctttgcactattgtaaagttgaaaaatgttaagtcaaaccattgtaagtcagggaccatctgtacctatccagtgagataggaatatctcactgaatgataccatcatccacccagttatataggctgggaatctgagggagggagagggtgggtaaccctttatgtctctcttttgctgtacccatgtcctctgccctatcccccggtaaaatttgtcagagttctgctcctgccccccataaaggtatttaattagggccaaagactctggtttgggggaatggttgctttagactagttccaagtcacccactggactatctggattggtcacatgggttctgtcattttaacctaaaaatctccagtctgtccacctttccacatcttcatttttacctccttttcccaaactaccatcatttctggtctggactactgcaggaagcttccaagtatttttttgttcgtttgtttgagatggagtttcgctcttgttacccaggctagagtgcaatggcgtgatccctgctcactgcaacttccgcctcctgggttcaagccattttcctgcctcagcctcctgagtaactgggattacaggcgcccaccaccacacccggctaatttttgtatttctagtagagacggggttttaccatgttggccaggctggtctcgaactcctgacctcaggtcatccacctgccttggcctcccaaagtgctgagattcgtgcccggcctcccaagtagtcttcttagagcatgtggcccacctccaattcattcttgaccttcattgttccttcccgtgcctattactacttaaacccctcctcagcagcatcccattacttttgggagaaaaccaaatccttaatgaggccttcaggactctttgtggttctgctcctgcttctttccactcattctcttactctgtgtgctcaggttatatggtaaacgagcctttcaattccttgaacctgtagtttctcttaccacaaggtctttgcgagtggtgtttcctttctttgtaacgttcttccccccaaccatttacctcctactcagacatcacttagctactcaagggaggcctactctgaccccacattataagtcaggatcctttgttatatactcttgaagaactgtattcctctccttagagatttatctttttgttactttgagtgtgtgttattatttgcttctaccacttcacctcagtgaaaagcagagaacatacaagttatttagtcattatcaactgcgctttgtgtaccttgtgggacttaggtactcaatacatttttgttgaaaatgaatcagtctctgaacactctggtgatagatggtatattaccctaaagcttgcctgtaatgtcatacagctatgttaggtctttgttatctggagttccatgtaacttttatacgtagttactatttctgctgtttcaagccatacggaactaaacacaattctttttccatgtaatagctactcaagctactcatttacttgaatacaggttacatatctcctcagattttcgattttgcaagttaaacatcccccaattcctagcatatttcatattccaaacccttcatcatttaggctaccttcctctggaagtaacctaatgttactgttttgtcaacctttcttctaaaatgtgcccagagtggaacacagtgatcagagaagaatgtacttaagctattattgtcttgagatggacactaccattattcataccagataaaattgtattagcgttttttctatagtaaatcacattcttggctcatactgagcttgtagtcagtgaaaactcatgttcttttaaaatcagctccctagctccattctaggtttagagcagttttattgaacctaaatcaagaccttatccttttacaattcatttttttaggtcagtgcatgtctgctgtttgttgaggtaatctggattcttagttctttcatgttaggaaacataatagctgtctcttccagtttggttagatctgtaggtttaatcatgacttctgtttctacgtttgagttattggtaaaggatagaataagacagggtcagaaataacccttggacatgctgccagtgacatgcctctagactgatacccattaatacacttgggcactgttgcttaaatacagatgtgtctcatttaattccaacaaaacaacctgcaaagtaggtagtattatctttgtttttttgcagagagaaagagagagagatttagtaacttgagaagttcacatagccagcaagaagcagggtcaagatttgaactcagatcagcctggtactgttacctagttcaccagcttagttgcaagagtgtagtaaagactaggtttacctcacctagaactttttggacataataatgttcagaaactatcttctaccttttggaaaatctgaaaaactttggcccatctgattgtctatcatttcttctgatagcctttattttctagtaactactgagtgatttttagcaaaaatagttcaccttgttgcaatacttttatttgtgcatatttatggagtacatgaaaatttttttacatgtgtataatgtgtagtgatcaagtcagggtacatgagtccaatgtattaagtatagtcatctactcagctatcaaacattgaatttattcctcctatcactggatcttttttttttttttttgagacggagtcttgctccgtcacccaggctggagtgcagtggtgttatcttggcctcactgcaacctctgcctcccgggttcaagcgattctcccgcctcagcctcctgagtagctaggattacaggcatgtgccaccacgcccagctaatttttgtatttttagtagagacagggttttaccacattggtcaggatggtcttggactcctgacctggtgatccacccgccttggcctcccaaagtgctgagattacaagtatgagccaccgcgactgacctcattggatctttttaccttttaacccacttctcttcagcctttctctcccttactccgccttcccagtctctgttatctatttttccactccctgcctccttgtgttcaaattttgtagctcctacatatatgtgaaagcatgcaatatttgtctttttgtgcctggcttatttcacttaagagaataacctccagttccatccacattgctgcaaatgatatgatttcattctttttatggctgaatagtattccattgtgtacatgtatgacatcttctttatccattcatctgtagatggacacttaggtggttgattccatatttttgctattgtgatagtactgcaataaacatgcaagtgcagctatccctttgatacattgatttcttttcctttgtgtagatacccagtagtgggattgctggatggaaggtaattctatttttagctttgagaaatctccatacagtgttccttagtggttgtactagtttacattcccaccgacagtgtatgtgagagttcccttttctctgcatccttactaacatctgttactttttgtctttttaataatagccattctgactggggtaagatgatatctcattgtggttttgatgtgcatttctctgatagtggtgtggaacatttttccatgtcttcttttggccattgtatgtcttcttttttaatgggattatttgttattttccttttgagttgttcgagttccttgtatgttctggatatcagtcctctgcttgatgaatactttgcaaatattttctcccattcaacaggttgtctcttcattctgttgattattcttttgctgtgcagaagctttttagtttgcttaagtcccatttgtttagttttctttatgttacctgggcttttgatgtcttaatcataaattctttgcttacaccaatgtccaggagtgttttccctagactttcttgtagtatttttatagttttgggtcttaaaatcttcaatccattttgagttgatttttgtatatggtgagagataggggtctagtttcacacttctgcatgaagttatgcaattttcccagcatcatttattgaagacagtgtcctttccttagtgtgagttcttgtcagtgttgttgaagatcatttgtctataattatgtggttttatttctggattctctattctgttccattggtctacatgtctatttttataccaataccatgctgttttggttactatagctttataatatattttgaagtcagataatgtgatgtctgcagctttgttctttttgcccaggtttggtttggttgtttgggcttttttctttttccttttttggtcccatatgaatcacattggtattttgatagggatttcattgaatctgtagattgctttggcaatatggtcattttagtgatattaattctttccacaagcataggatgttttttgatttattttctttcattggtgttttgtagttttctttgtagagatctttcacctccttagttaaatgtattcctaggtttttgtttgttttcggtagctattgtaaatgggattgccttcttaatttctttcttggctagatccttattgatgtatagaaatgctactgatttaaaggttttctaaacctacagatatataatcagcaaagagacaatttgactttctcttgtccagtttggatgcctttcatttctttctcttgtctgattgttctggctaggatttccagtactgtggtgaataggagtggtgaaaatgggcatccctgcctcattccagcttttagaagaaagatctcacctctcctcattcagtatgatgttagctctgggtttgttgtgtatagactttattattttgagatatattccttctatgcctaatttgttgagagtttttttaatcatgaagggatgttgaattttatcaaatgtttttgttgttgttgcaatactcttttttttttttttttttttttttttttgagacagagtcttgttctgttgcccaggctgtagtgcagtggcgcgatcttggctcactgcaacctccactcactgggttcaagcaattctcctgcctcagcatccctagtagctgggattacaggcctgtgctaccacacccagctaatttttctatttttagtagagacagggttttgctatgttggccaggctggtctcgaactcctgacctcaagtgatttgcctgccttggcctaccaaagtgctgggattacaggcgtgaggcactgagcccggctgttgcgatactcttaatgggttttatatttcctttttgtgggggacagtttattttgcattcttactacttttgatattctgacatcatcttataagtgggatttatattcactatgtaattgaagttttttccaatgaagcaccgtatatagtttatctgggaaattggctgaagaataaaatgtgtgatgttattcagtgtacagtttctaggtcatcagaagataccactaccttcccactactggaaaagaaaaaagaaaagttttccacagtgcctgaactgttttgtatgcttatcttttaaaattgccagaaatctcacttactggagattcagcagtccctttctgaaaatacacatactttagtgcaaataaagccagtggatctctttcttcataagtccttaaacctagtcgaggtcatctgtttggcagagataggagtaagataatgtgaaataggaaccaacgagagagaacttgcttaggagttgaaaggggtatggaaagatgttagaggtaaaatttgtcgaatctagtgttttgactagggcaggccagaatattcagtatcagtatcaatatcagaagcttttgtagcctttgtttagaaacctagtcatttataacattttgtgggtgaatgacatcattaccaaacaaactttcagatgaaactttggaactcaagctgtaaattgtggatagctcatgtgcagtactacaaatcaaaacaaatactataaagtgtttggtagtccatttcctgaatgaaagtttgtccaaagtatatcaactttctgcagtcttacatgcagtagttattagttttgtgtatcgctttagtggatatttttaaaagtatcttcaaatgcaatgaattttaggaaacaaaacaattctttaaagcatcattagatagcttcttctttctgaaacccagaggaatttatgtataggatgactctttttttcaagtagttaagttaaggtgcaaaagtataaggtaaagtatattatcttaccattgaaaattttggcagtggcagaagagcgaacccttacaaataccttcattgggcaatacactaagcacttgctgtaatgctttttaaaacatctatactctggctgtggtattttaagtgaaaatctctcagtgagatactctttcgtattttagtactgatatccttaatattgctctgagagctaccttatactgacttcagtttcctagtgatttaaactactaatttccaacttatttttttttatagtgaaaactaaatattccttttgtagatgtaaccatttctggaagccctaagtatttttgaatgagtataattcatgcacactttaagagatttcaagcatgacaagcacagtgaataacatatatccatgtgattaccactgaggtttaagaaatgttaacatatgatatctgcttcagatatttatctttttaaaaatagaacattacagctgggcatggtggctcacacttgtaatcccagcactttgggaggctgaggctggtggatcacctgaggtcgggagttcgagaccagcctggctgacatggagaaaccccgtctctactaaaaatacaaaattagccgggcatggtggcacatgcctgtaatcccagctactcgagaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctcctttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgtgtgtctttaaaatgtatataatggttttatgctatatctttctttctgcaacctgcatttttcacttaaaataattttgaaatttagtcctgtggatatatagtgagccaattaattctgcttagctactctgtagtctgttttgtgaatataccacaatcatctactttcttattagaggacaatttaggcagttccaattttatttttcccggaatgtacattattttagtcgagtgccattgccacattagcgatattttggttagtgagggactgcagataggaaggtgatcccaaaagattataatgccatatatttactctacctttctatatttacatatgtttagttacacaattacccattatgttacagttgcttacagcatttggtgctgtaacatgctgtacaggtttgtagcctaggagcaataggctataccatataggtttgtgtaagtacgctctatgatattcatataacgatgaaatcacctagtgacacatttctcagaatgtatccctattgttaagcaacacatgagtgtgtgtctccatgcatatatgtgtaagagttagcatgtgtgtccagaggtagaattgctgggcgataagtcatactcatctttacctagttatgccagtttatactgtcactagcagtatatgagtacctgttatttatatcctctccaacacttaatattgctgacattttaacttttacaatataataggtgtaaaactattgtttaaatttgcatgttgtcctcattactagtgagattaagcatttttcatattggtcattgggatttccccttctgtgaattacttttgtatatttgctcattttttctgttgggctgtgtatttttttagtgatttgtataatttttcgttttttggggggtagggtatgctttggattctaatcctttgttgtaaatagcttctctcagacagtgatggtcttttcatgatgtttatagagtgttggatttaaattttatagttataattaccctttttttttttttaccttggtgatttgtgcttttatgtgtttttcaggaaatctttctccaccctgaagtcattttcttataaaagttttaaaattttgccttgcacattttggtgattgatcaggaatttatttttgtgtttggtgtgaattatgaactaattttatcttttccatatgtataaccagttgtctcaatatcatttattgagtccatttttttcctttactgatttgcaatgctatctctgtattatatccagttcccatatatgtgtgggtctaagtgtcgactctattccgtttcataattctttttgtccatatttgcatcaataacactgttttaattgctgtagctttaaaattattcttgttatttcatagggcgtactttcattacctttcttaatttggcatttcttggctcttttccgtatgaattctgggaacaacttaatccccactcctttaaaaaaaaaaaaaaagacactttggcctggcatggtggctcacacctgtaatcctagcactttgggaggctgaggcgggtggatcacttgaagccaggagttcaaggccagcctggacaacatggcaaaaccctgtctctaccaaaaattagcgggcatggtggcacacgcctgtaattccagctacttgggaggctgaggcatgagaatcagcttgaacccaagaggtggaggttgcagtgagttgagatcgtgccactgcactccagcctgggcaacagaacgagacagttttttgtttgtttgttttaaagacacttttaaccttccgctatggatttttgacctacatttttcctcttgtattttataagagtagacacagagagcacttcaataaaattcagctcaataactttattaacctgatctccttttctttgactttaagctgaaagtgttaatttctcacaacttgtgctctatagatttgaaaccaaatcaattagcatcagctgtttatgagtaatgcagggtattttggtcttttgctaaattcagaaagaaatgttaaagtgctgatggatttgcactagctgtatagatctttggtggaggaggaaatgggaaaattattaatttcaggtaagaagtcatttttgaaatgcaagattcatttctttttaaaatcaccacataataaaaactttaagggctgcattggtgggtttttaaaaaaaattgtgaagtgtttttagtgttatgtgctgacaaatatttttgtagttgctttgacaagcaatgaaactaccaattatcactaattctgagtcttccaatgaacctctgtgtcaaatttttaaatttaattatcctgactatttttctcctagagaataatattgatataattttgtgaaccatagcagacagttcccattgctgagaatagagcctggtgtggggatattatgattcttgaatggttgaacaagacatttgcttctgaacatcttagtaaattatcacttctgacaatgtctgtagtttgaattttgatattctctgccaaggtattgaatactctaaataatgttgtttattctattatttaaatcattagtattatagatctagctttaaacagctgctgcactccagtcctttttcttcacctgcagatattgagtctgataactgttttgtatacatagcctttcagtaaatctacttatcagtcatcaaattaacttaattataagttaaatgatgagatggaccaagagtgttattgaaatctcatttccacacatttcttctcttcttttgtagaaggtaatgaaatgaacctgtcagtgttcctgtttttatgaagtttatttctcttagtacagtgattctgatagtgggttctgcagaccagcaaattagcattatctgagaacttgttagaaaagcaaattctcagttcccacttcaggctgactaatttagaaaccctggggtagggcttagcattctctttcaataaattctccaggtgattctgatgtatgttaaagttgagaagcattcacttagtgttttgagctctccaatttagttccttataaattgttgaagatattttttccagatttctttccaaatatgtgctcaaccttgttactgataggtttcaaggttatcgtcttcttcccattaataccttcatctatatccaattttcaaacttttaagaaagcatggctattttgctgcagtatggtgaattaggtactctgactgaccttcccagataaacaatttaaaattctagataatttttttttggagggaggacagggtcttgctctgtcacacaggccggagtgcagtagtgtgaacatggctgactgcagcctcgacctgttgggctcaagcgatcctcccacctcaacctcccgagtagctggggccacaggtgcacaccaccatgtccagcaaatttttttattttttgtgcagatggggtcttgccttgttgcacagactggtctcgaactcctgggctcaagcagtttttccacctgggcctctcgaagtgctgggattacaggtgtgagtgactgtgcctggcagatgaaatattttttaagtaaaaaccttatgtgcatggagatagctggctgaaaagtaaggaataatcaggccaaaaactatgtgaaggtgaaaacccagagatataagccaagtactgctgccttgaggacattatttgcaaatgacattacttggaaaacctagttaacttgtgcttgtgcctcaagaagctcagagaacggaagataaaagtagttttctggtagaacgtcccacctctcctggtaaagatggtaccccaagggtctatacatcataataaatgagaactagtaataaacgtaccttgtctaaggatcggaaagaaaaatttcctgcctcaaactttggtggtgatgggaagggtacagaaattccctgagaagttttacccacaagctgaccttcatgcaggtttgaatcctgattttatattacctggatggtatgaaaatcttaagccagtaattaaatataaaagtggtacaagagtgacgatgccttaaaatgcctaagaatgcctaaaaagcagcaaatacaaagcttcttgggagaacccatcttgatcttaggatttagaaaattcctaaacataaagctgtaagaaatatgaactcacattcacaaaatgcagaaagaaataagatgcaatgaatgagaggaagcagaaacaataaagagcagaatcagaacctgcaaagagttcacatattggagttagcagacacagattataagtacatatatttaatatgcttatagaaaaaaagaaatttaaaataggaatgaggagcaagtatacaaaaatgaccagtgtacaaatttaataacagattagacacagctaaagaaagatttagtaaagtggatctgaaaaaattgcagtatagaggcaagaaaatgaaaagtaataaaagagttaagagaatacagagggtagaataagaaggttcagtctagtcagaattctggggcaggggagcaggggcatggaaaagaatgaggcagaggcagtatttgaagagataatgacagagaactgatgaaaaacaacctacaaatttaggaagctaaagaatcccagaaaggataaaaagaaaaaaaattcacacataaacattttttaaagaaactacatgataccatagagaggtcttaaaagctgtcagaggctgggcatggtggctcacgcctgtaatcccagcactttgggagcccgaggagggtggatcacctgaggtcaggagttcaagaccagcctcaacgtggagaaaccctgtctctactgaaaatacaaaattagccgggcgtggtggtgcatgcctgtaatcccagctactcaggaggctgaggcaggagaattgcttgaacctgggaggtggaggttgcagtgagccgagatcgtgccattgcatgccagcctgggcaacaagagcaaaactccatctcaaaaaaaaaaaaaaagctgtcagagaaaaaagatattaccttcaacaagtatttggctgtcagctgttttcctgtctataataatgaaagccataagacagggagtaatattttccatatgcttagagaaaataattgtcaaccaagaattgtatatcttgtgaagaatgggggcaaaattagacactttaaaacagacaaacactcaatgttgtaaccatcaaaccttccctactagtggaaattcagatcaatttcctgaaggctaaaaaaaaaaaaaaaaagtgaccactgatgtaaagtctgagatttaagaaggattgaagagtaaagaataatggtaaatctgtggatatattgaaataaatattggctttataaaatgatgtatgcggaggttttaaaaatagaactaaataggccaggtgtggtggctcacgcctgtaatcccagcactttgggaggctgaggtgggcggatcacctgaggttatgagttggagatcagcctgaccaacatggagaaacctcgtctctactaaaaatacaaaaaaaaaaaaaaaaaaaaaaaaaaaaaaaaaattagccgggtgtggtggcgcatgcctgtaatcccagctactcaggaggctgaggtaggagaattgcttgaacctgggaggcagaggttgcagtgagccgaaatcacgccattgcactccagcctgggcaacaagagcaaaactccgtctcaaaaaaaaaaaaaagaactaaatatatgataacaacatccaaatcaaaagagtggttaaagtattttatgatctttatactgttgaagagaaaggtaaagctattcaattaactttagattttgataggtatgtgtattagtattttcagagtaactactaaaataatataaatattaggaataatttatagcagaaaaaacaatttttaaaaggcaaggaagaagtgaaaaacatagaaaaggtcagataaagaggaaacaataaaatatagaaatcaaatcaaatatatggtagactaaatgcttcattcagacaaagaatgtcagattggattatttaaaagcaagcaggccgggtgcagtggctcacgcctgtaatccgagcactttgagaggctgagacgggtggatcacttgagatcaggagttcgagaccaccctggccaacacggccagctggccatggccagctaatacaaaaattagctgggtgtggtggtgcacacctgtaatcccaggtacttgggaaggtgaggcaggagaatcacttgaacccaggaggcggagattgccgtaagccaagatcatgccaccgtactccagcctgggcaacagggtgagactctgtttcaaaaataaataaataaataaataaataaaagcaagcaaacaaacttactgaaacaacacaaaatccagctataattttcaagagagatagctaatacatatgaatgtagaaagatagaaagcaaaaggatggaaaaagtctatcaggcaaactctaaccaaaagggaggtaaactaactatattagcatcagacaatatgatctttcagacaaaagagacagctagagataggtccctcaacaatgagaaaaggtttatttatccataaaggtaaaaacaattccaaacttgtgtgaacctaataattgcctcaatatacaaagaacaaaatgacacaattataagatgaaatagacaaatctaccatggtgaggagtttcaaaactccctaattgaaaaattaaaaagacaaaatggttacagctgaaaattaaaattaaaaattcattttctcggttgcaatagccatttttcaagggcttactagtgacatgtgacaatggctgctgtattggacagcacagaaagtacttttgcactgcattaatttagaagacttaatataattaacaatattaataattgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaaaaaagtgattaattggatttcatcaaaagacactgacttagtttgcttaggctgccataacacaatactatagacttggtggcttaaacaaaataaatgtattttctcacggttctggaagctggaagtttgggaccggggtgccagtatgactgcgttttggtgagcactgtcttcgtgacttgcacacaggcttcttgccacgtgtctgtgtggcggagagacagcaagatctcaccatctctcttccttttcttataaggccacagtcttgtcagattagggcccttcgcttatgacctaatttagcctcaattatctcccaaagtccctatctccaaaatagttggggtgggggaagtgccttgactaatgaattttgttgggggcagtggggagtgcacatttcactccatagtagacaccattgaggagaaagaccagagtggaagaaggtatttgaaatacatgtatttgacagccaggcacggtggcccacacctgtaatcccagcactttgggaggccgagctgggcggatcacgaggtcaggagatcgagaccatcctggctaacacagtgaaaccccgtctctactaaaaatacaaaaaattagccaggcgtggtggcgggtgcctgtagtcctagctacttgggaggctgaggcaggagaatggtgtgaacccaggaggcggagcttgcagtgagccgagattgcgtcactgcactccagcctgggcgacagagcaagactctgtctcaaaaaaagaaaagaaaaaaagaaatacatgtatttgacaaggacttgtacctggaatatataaagaactacaaatcaagaataaaaagaaaggacagaaagccaatggaaaaatgaacaaaggattcaaacagggatttcacaaagaacttacctgtaacgtatgttaaatgctcaacctcattagtcatcagagaaatacaagttaaaacctcagggagatattactacacacccaccagaaagttaaattaagaacacatttgtcatgacaattctgggtttgattttgttttgttttttgagatggagtcttgctcttgtcgcccaggctggagtgcagtggcataatcccagcttgttgcaacctctgcctcctgggttcaagtgattctcctgcctcatcctcccgagtagctgggattatgggcacccaccaccacgcctggctaatttttgtattttagtagagatggggttttgccatgttggccaggctagtcttgaactcctgatctcaagcgatccacctgccttggcctcccaaagtgctgggattacaggcatgagcccgcgcacctggcctgtcatgacaattctaagtggtgatgaggatgtgcagcagctggaactgatgaaaatgcatgagcacaacctctttggaaaactagcagaattccctaaaactgaatgtaggcatgatgcccatgacccagcacttatagtcctgggggtgggaggagtgaatatatttctattcatgatttctatctctgatgacagaaattaagctagtgggtatctgtggttgagtagaaggatagtgactaggagcgggcagtatgggatgctggtaatgtcctcttgacctaactgttggttaccctgggtgtgttcacttgtagaaattcattgagccaaacacgtacaatgtatgcatttttgtgtatatatgttcttcttcaataaaaacttgatttaaataatgttctttttcttaaactgggtagtaggtttatggtgttttatgtgttgcctgtgttttatacatattttattcctgttcagtgtccaaaaaatataaaaagtagtcactgctttgttgttaatttgagcatctcctgcacctagcacagtgcctgggacattatagatatttattaaatatttgttctatggaaaagaagtaggctagtaatttctttttgctttccaacagccagtttttgattcaattatttgtaaatatgatttctactcagttgtttctaaataataaaatatgtaaatactattatgtttatatttattagtaagctgaatttattaaatgagaaacctctcaatattaaggacacatcataaattattagcatgctgtgttataatgactaaaagtagtatcaacaatttagataagtatagtgtggccttacggatgtaagtccgtaagatcatgcagcattgaagatgtgcagtttactagatcttctaatattctcgggtgtctcactgtttcttttttttttttttttgagatagggtatcactttgtcacccagtctggaatgcagtggcgtgatcagggctccctgtagccttgacctcctgggctcaaacctctcacctcagccccctgaataacggggattactgatttgtgccaccaagccaggctaatttattttctttctttctctctttctttctttctttctttctctctctctctctctttctttctttctttctttctttcctttctttccttctttctttcttttctctctttctctctctctctctctctctctctcttcctttcttcctttctttttgtagagtttgggtctcactatattgcccaggctggtcttgaactcctggcctcaaatgattctccctccttggcctcccaaagtgttgagattatagttttcagccaccgcacccagcctcactgttttcttcagttgtttctgaacaactggaatctcagctgtctttttccattaaatcccgtgttcgttcctccataccatgctgcctcttgcccatttttgcatttctcctttctgctttcctgaacatcctgagtcttactgggctggcattcccttgttgggacaggggagaggctctaggccttggatccttgttctgattccttctccaaagagttttccctttttcttcccctttcaaaacaacataagtgcaaaagctttgtcaggatgttgggaattaaaaaagcttcagaaacattttgattcatttaacaacattactctgaaactttttagagtaagagtaccaagtcactgaataagacgatcttgaaattaaacgatattttacagttttaaaaacaccttcacagatcttttcttattagattctcagcacaaccttatgagttggcactgtcaaaattcagttcaacaaacaaaatccaactaacaggaaaactcacagctaacatcatacttaatggttgaagactgaaagctttcccccttaagatcagaacaagacaaggatgctcttgccactcctattcaacactctattggtggttctaggtggggcagttaagcaggaaaaagaaaagacatttatatcagaaagaaataaaactatatttaccgatgacatgatcttacatgtagaaaaatcctacagaatttaccaaaaaaaattggaactaataaatgagttcagcaaagttgcaggatacaagattattatctaaaaatcagttgcattcctatatgctagctatggataatctgaaaatgaaatagaaaaaattccatttataataacatcagaaagaataaaatacttatgaataaagttaaccaaagaagtacactaaaaagtacactaaaaaacagaaaacatgttgaaggaaattagagatctaaataaattgaaagacgtcctgtgttcatggcttggaagacttaatattgttaagatgacagtgctacccagatttatctacaggtttaatgcaatcactatcacagttcaactgcctttttcccggaaatggacaacctgatcttataattcatatggaattgcagagccatatttgccacaacagtcttgaaaaaaagagaacaaaattgtaggactcatacttcctgatttcaaaacttattacaaaactacagtaatccagatggcatgtcactggcatgaggagagtcttgtaaaccaatggaatgcaatttagagtccagaaataaacccatacatttatggtcagttgattttgaccagggcgccaagatcattaactggggaaagaataatcttttcaacaaatgttgctggggcaactggatatctacatgtaaaaaaataaatttggatccctgcctcacatcacatatgaaaattaactcagaatggatcaaagacctaaacctgttaagttcttcgaaggaaacataggtgaaaatctgtatgaccttggattaaatggtgatttttaaagatataacacaaaaacacaagcagtgaaagaaaaaggtagataaactggactttgttaaagttaaaaactttcatgcatcaaaggacactgtagaatgaagacaactcacagaatgggggaaaatatttgcaaattatatctctgataagtatatatattttatatatatgttgtttatatccagaatatgcaaagaaccctttcaactcaacaaagataagacaatggaatttaaaaatgggcaaagcatttgaatagaatagacatttctccaaagaagatgtacaaatgacctataagcacatgacaagatcttcaacatcatagtccatagggaattacaaatcaaaaccacaatgagagataacactttacaccctctaggatggtcatactttttttttttttttttttaaagacagtaacaagttttgataaggaagtagagaaattggagccctcattgctgatgggaatgtaaaatgatgcagctactgcacaaaagttttgcagttccttaaaaaactaaacatagaataactcagcaattctactcctgggtatagacccaagataattgaaaacatatgttcatacattaacttgtacatacattaacatgtggcattattcatagttgccaaaaagtggaagcaacccaaatgtccatcagctgatgaaatgataaatacaatgtggtatatccatacaatgaaatcttatccagctgtaaaaaggaatgaagaagccaggtgcagtagctcacaactgtaatcccattgctttaggaggccacgatgggaggattgcttaaggccaggagttcaagattggcctgggcaacatagacccagtctctacaaaataaataaataaaaagaatgaaatactattacgtgccacaacatgaaccttggaaacattatgctaggtgaaaatccagtcaccaagatgacgaattgtatgattctgcttacgtgaaatgtccacaataagcaaattcatagagacagaaagtagattagtggttgagaaggagtgagagaagggatgaattgagattaacggctagtagggacagagtttctttttggggtgatgggactgttctggaattagatagtgattatggttgtacaacatagtaaatatactaaaaaccactcaaaggctgggtgcagtggctcatgcctataaccccaacactttgggagactgaggcgggaagattacttgaggccaagaggtcaagaccagcctgggcaacacagcaagaccttgtttctacaaaaaaaaaaaaaaattgttttaattacctgggtatggtggtgtgtgcctgtagtcccagctactttggaggctgaggtgggaagatcacttgagcctgtgaatttgaggttacagtgagctgtgattgtgccactgtgatccagcctgagtgatagagcatgaccctgtctctcaaaacaaaaccctccaaaaaacaaaaaccacccaagtatacattttaaatgattaattttatgtgaaatatatcagctgggcgtggtggttcacacctgtaatcccagcattttgggaggcagaggtgggcggatcacgaggtcaggagatggagaccatcctggctaacatggtgaaaccccgtctctactaaaaatacaaaaaattagccaggcatggtggcacatgcctgtagtcccaactactcaggaggctgaggcaggagaattgcttgaacccgggaggcagaggttaaagcaagccgagatcatgccactgcactccagcctgggcgacagaacgagactctgtctttaaaaaaaaaaaaaaaaaaatctcaaaaacggcaatgagaactcaattaatatttatcatactgtatattccctgagtggtgcaggagaatcagagcttagaatcttgtgaggaaggcatggtacttaaataagtctagtgtaaggcagcttgtaataagtagtactaagactgctgaagaagcacaaataaaggagatattctatcttactaggaaccagggagtttcacaaacttggctttgcaaggtgggaaagattttcacaggtggaaggggtttgaaatagggaattcagtcaaaaggaatagtgtgagtgaaggaatggagtttggaatgtggggtacatggggttggggtggggtattgaggtagatgacgcagaaaaataagttaaagatagatcttgcataggtggctgtgagtagcatgctaaggagtttgggctttattacttatgaatcatatttttggtttcaggtcatgtctggtggcagagggaaggctgaattggaggagaacaaaagctagaaccagggacaacaattattaccattgtagttttttaggagaggtgatatggctgaactaggttatggttgtgaggctggaagggaggcacatccaagtgacagtgcagtagacttagtagactcttgattgtttatgtgtgcattccagggataggcagtgaagggaagaatgaccctgaaatcttgaatttaatgacttgaaaggataatgatggtattaacagatgaggaacatagcaagacaaacaaatgaaaaagtgaatactgaggagaaggaggtaccactgaatttggcatttagtcattggtgattttgaagacagcagttacagtaaagtggctgctggaaaggatttcaaagaatggttgaagaagatagccataggatgagaacatggaaggcaaggaagggagacttgagagatttggtaataaagagaagagagaaaagggtgctagtttgaaatgagttaaaagaactacagagtagaattaaaataaagtagaattatgggatttttgctttttaagtgacccatgagaggcttactggcagtgtgccaagattcaagagagcaaagattggcagggtgggattaagtgatgggatagccgggtgcagtggctcatgcctgtaatcccagcactttgggaggctgaggtgggtggatcacttgaggtcaggaattcgagatcagcctggccaacatggtgaaacctgtctctacaaaaaatacaaaaattagccgggtgtggtggtggttgcctgtaatcccagctatttgggaggctgaggcaggagaattgtttgaacctgggaggtggaggttgcagtgagccaagatcgagccactgcactaactccagcatgggtgacagagtgagactccatctcaaaaaagagaaaacaaaaaacaaaaaaaaacgacggtagggagccttctgcctctttaaacatttgagatgcatgtcctgagatgcttctgtgaagttaagaatattaattttttgatacgaatctgacaaaactagacatcaaaatatgccatatatggtaattaaaacaatgtggtattagtatagaaagcagacaaatagttaatgaagtagaacaaccaacccagaaatagaaccagatacacctgaaaacttcatatatgaggtttaaaatcagtgtggaaagctggaaatcacccatagtttcgttatccagtcagttgtttttcacattttggtgtgtttccatttagttggtttgccatacttttttaaaaataatgctttaaggctgagcgtggtggctcacacttgtagtctgaagcaggcagatcacttgaggtcaggagttcgagaccagcctggccaatctgatgaaaccccatctctacaaaaaatacaaaaattagcctggtgtggtggtgcttgcctgtagcctcagctacttgggagactgaggtgggaagatggcttgagccagggaagcaaaggttgcagtgtgctgagatggcgccactgcactccagcctgggtgataaagccagaccttgcctcacaaaaaaaaaaaaaatgctgtaaagtaaaagttctgtatacaattctgtgatatgaaccctaccttagtgtgttatgaggattttgatccttatatgatatgatatatataatcaagtgcgggtacgttgtagtttacagaaccattactttgaaacaagacctttaggttactcctaattcatcactgttaaaataatgctgtagggaaaaaattacacataaaagttttctatatttaaagtgatttttgtgagacaaagtttatttattgtaaaaacagttccagcagttcagaattgtaaagagttttacagaattgtaaagagttcagaattgtaaagacattttcttgtctttctccttggtggtaaccactgttaacagtttagtgtgtatcttttttttaagtttagtttttatttttttgtagagacagggtcttgctttgttgcccaggctggggtgcagtggtgtgatcatagctcactgcagcctcatactcctgggctcaagcagtcctcccacctcagcctcccaagtagttgggactaccggcatgtaccaccacgcctggctaatttctgtatcttttgtagagacagggtttcaccatgttgcccaggctggtctggaactcctgggctcaggcgatccccctgcctcggcctcccaaagtgttgggattacaggcatgagccactgcacctggactagtttctttttaatttctgagtagtagtcaattgtatggctctcctataatttcttcattcattcatcttttggtagacattcatgttgtttccatttttaggctattatgagtacagctgttgtgatcatttgtgtgcgagtctttgtgtggatatattttcatttcttttgactaaaaacctaggggtgcacttgttgggtcacattaactttgtagaaactgcattgcatctttgccgatattgaaagttgtcagccttttatatttttctgtgcatgcttttccccccaaaagaccaaaatgggaattgtttttcttttcattataaacttgtaaaggaattttaaagttctaagggatgccaggcaggaggttcatctatgtgaacagttattagtttgagatagataatgtcaaggatatccctaaaggcttttcaagagataactataggacatataagtttaacttatttctaccccatcacttctagtcacatgtgacttcagaattttaacagaaattattattataggaatatgtagcacagagggattccataggcctgaagattagtactgatggcctttcttgcattattctaggctagtgctatccgatgaaactttctgcagtgataaccactagccacaggtggcttttgaaacgtagggctagttcaactgaagaattgaatttaactttaaattaatttgaatagtgaaatatgtctagtgattaccgaacagtgtagttctgaaatgttatttttcaggaaagatcctctagcaagaagtagttgagtgagacctgttagctgagctggccctggggcaggtttgtgttttcagtccttccctttcctgtgggagaaatgaaaccaaagcctagagcaccacagaagaagaaccagtggattcataagggtgacagttcaggtaggggaagctgtttggtaatgagctcttttggtcagatgccacactatttttctttctgtttattttgccctattaaattatttagtaaatagtaaagcgtactttaatccagtttttaaagtggacgtttggatgaaagtatgtgatttaaattccaaaactgtgcagtgttgtccagaagagtcctgattaaatcaccccagtttctttgatgaagataagcaaataattttattttttgctgtaatcccagctactcggaaggctgaggcaggagaatcgcttgtaccagtccggaggctgctgccctctcacagggcttcctcctcttgcacagacgcaccagtgccttcagccccactggtctccctcttctcctttcctggcccctgctggcccagtagatgggccactggaggccactagatgggggctggggaatgtgatgttggcgatctgcggtatcttcagggtgacagccatacccaacgcgtgggacctggcttccacatctatagacctgacctaaggaaatatgtgggcgtgtgcataaggatgccatctcagaactgcatattaataaaaagctgaatcaaacagtgtccaacaagggtggctgttccagctggtcatctacaatctcagctcactgcaacctccgcctcctgggttcaagcaattctgccttagcctcccgagtagctgggactacaggcacacaccgccacacccggctaattttttgtattttagtagagatggggtttcaccatgttgcccatgctggtcttgaactcctgagctcaggcagtcctcccaccttggcctcccaaagtgctgagattataggcgtgagccaccgcacctagcctgtactttcatttcttaataactgcatgactgtagtggttggctttcattattgtttcctaggggcaaggtcaatgttagaaaaattgtggaattttcccttggcattgctgtggtgagtagacagctactatttatagagacttatacttcgttgaaaaaatgagataccatgcctggcttaccataaaaacacagatgtttctggattccagtagggaggccttttgttcacagcatctgttttggttggccagccagatgacttctgtggattttttcactccttttgaaggacacttgacaaataaacaagtttataaatgaaagagttaacagcattttgtaaatttattttattactttagctatatcgttctgtatattttgaactatcagatcattttagctcaattttatcacttcctaaataaccttgagacgatcagtcctttgttacatgttctttggattgtttattctgcagttgagacagatttttattgatctataaatttttgtgttcaacaaacatttaatgagtattcactgtgtactaggccctgtactaacactgggaactacatatgtgagcaagatatagtctcagtctttgagaagtttagtgtcttatatgcagtgcaaacatgtagacagaataaaattatagttgagtccttccatttgaagtttatttcatcagtttagtggggaggggtaggtgtctaggaatgccttccagaaaaagtagtgtctaagtggagaattgtagaatgagtgggagttgtccagggatggaacaggggttagtggcggagattatataaaagaaagaagcttgcaggtgaaaatgaccctgggaaagtgggaaactgaaaaagttcagtacatttctgtcatatggctgatcaagctgtgactgggcaaaatgctgtcagcatttgttgaacacataaatgctgtctcattcacaaaggagacttgtgacctagactttattcatcttgtgctaaattagtgatttccaaacatttgatcatgaatctcataagtaaaaaatgttttgattatgtatcctcatatattgattatatgccaatatttgtttatagatgatatgtagtactaaaagttatatacgcagtagaacatgtatagaaaacaaaaaaaattaaaaggatgagctaaagatggcatgtacaatattctcacagtgttaattttactgaaaatacggaaagtaggctgggtgcagtggctcacgcctgtaatcccagcactttgggaggctgagggaggcagatcacttgaggtcaggagtttgagacaagcctgaccaatatagcgaaatcccatctctactaaaaaatacaaaaattagctgggcatggtggcacacgcccgtaatcccagctactcgggagggtaaggcaggagaattgcttgaacccgggaggcggaggttacaatgagccgagatcatgccactgtactccatcctgggcgacagagcaagactccatctaaaaaaaaaaaaaaaaaaaaaaaaaacccagaaagtaaagtggtacatcattatttaaaatcttcgtttaatattatgtgatacagctgctcagagggctgtttctaaattcagtttattttgatactttaatggcagtcaaagcctggatcaaaatggaagaatttggctgcactttctaaatcatattctttctttctccaaacttattcactatttatggaaatgctttattgaaatgtggctggtaaatatccatctattagtttttcttgcagattaataaaaatatattatacttttattgtgttaataaatgggttccaaaaatcactgttaagtcttcatttggaagatattttaaaaagttttagaatattctgtttctgactttataaagcatgaagatacgagtttttggtgtctttattttttagattttgtatatattgtttcaacagcagaataacttagcaatggaaatgtttccaattatccaattttgaaatgctctattaggaaagatttttttttctctcgctctctttttttttttttttttttttttttaaagatgaagcctctctcttgtccccaaggctggagtacaatggtgccatcttggctcactgtaacctccgcctactgggttcaagcgattctcctgcctcagcctcccgagtagctgggattacaggtgcccgccaccacgcccggctaatttttgtattttaagtagagatggggtttcaccatgttggccaggctagtctcaaactcctgaccttaggtgatccgcctgcctcattctcccagagtgctgggattacaggcgtgagccactgcacccggccgatttttttctctttttcttttttctggaaaagctgaaaataattctgacatgttgctaaacatttttattttgtaggggcagagtgagtttttttgtttttttaatatcttcttggtagcatactacttataacctcctcagaaatatttagcaagtttggaactctagtctttttattttaaaaaaattgtgtaactcatctacatttaacaaatcttttaaatacatttcttgtggtaactagtgaatctgtgtggatttaaaaacaaaaaaaagattatgaggccaaggcaggtggatcacttgaggccaggagtttgagaccagcctggccaacatggtgaaaccccatctctactaaaaatacaaaaattagtcagaagtggtggtacacaactgtagtcccagctactctgagctgagaatgcgccactgcattcaattctgggcgacagagcaagactatctctcaaaaaaaaaaaaaaaaaaaaattcagtggctactctctatctcccagagtataggaagattctatattcatacagttaacctcagtgacatctgaggtaccttgttctgacttaattgcagcaatagtttacctgtgaatgaagccgttaaaggcttttgtatcagatgctatcactgtaactttgttctggaatttttttttttttgagatagggtctcgctctgttgcccagactggagtacagtgacacgatctcagctcactgcaagctccgcctcccgggctcacgcctttctcctgcctcagcctcccaagtagctgggactacaggtgcccgccacaacgcctggctaattttttgttattttttagtagagacggggcttcaccgtgttagccagcatggtctcgatctcctgacctcatgatccacccacctcggcctcccaaagtgctgggattacaggtgtgagccaccgcagctggccagaattcttttttaaaattccagtcaaagcagtcatttcatcagtggttacagttttcccataaagcaccttgtttcatttacagttaagaatacctcccttttaatacattgttccttggtatcttacaaagttgtatttcctgtatatttcataattacccagcaaataccctaagatgaaagaatcatctgtatttttatccaattgtatagcaaaccccacacactgtatttgtcctgatatcttcaagtctttagggttttctaagagcttttgactatacttaccaataaaagaatacatttagtttgtcaccatttttatttctgtgtataatttcagctatggtccttggctttttttagggaaaccttagcagtttcgacactaactttcgtacaattttgtgaagtgtcacattaaatagcctgtgactttagacataggtggaaaaattatagacgtttaactcttgcagtgaacacttaaaagcctggtggattatgaggactttgttcgtgccatcagattatatcttaaggtagagtagacatgtagagtgaggttcatctttaataaaaaatgggctgggtgcagtggctcacacctgtaatctcagcactttgggagaccgaggtgggtggatcacaaggtcaggagatcgagaccagcctggctaacacggtgaaaccctgtctctgatgaaaatacaaaaaaattagccaggcgtggtggtgggtacctgtagtcccagctacttgggaggctgaggcaggagaatggcgtgaacccgggaggcggagcttgcagtaagccgatatcgcaccagggcagtccagcctgggtgacagagtgagactctgtctcaaacaaattaaaataaataaataaatagataaataaatggtgtggctggacgcagtggctcacgcctgtaatcctagcactttgggaggccgaggcgggcggattgcctgagctcaggagttcgagaccagcctgggcaacgtgatgaaacccccgactctaccaaaaattcaaaaattagctggagcatgcctgtaacccagctacttgggatgctgaggcatgagaatcgcttgaaccagggaggcagagattgcagtgagctgagatccaccattgcactccagcctgggcaacagagagagactgtgtcaaaaaacaaaacaacacataaataagaaattgtgtaaagtcaatataaataccagtactaatattttatttttataccccaaaggattatcgtataatacaaacacccttcaagtacacatatcccactttggagactaatgccctaaacaacagggataatgatattgaaactggccttttagttaaaataaaagcaaagccaaaaataattcactttcctctataaatttatatttgggagacacatttaagaataatcgtcctggccaggtgcagtggttcatgcctgtaatcccagcactttgggaggccaaggtgggcggatcgtgaggtcaggagatcaagaccatcctggctaacacggtgaaaccctgactctactaaaaatacaaaaaattagctgggtatggtggcgggcacctgtagtcccagctactcaggaggctgaggcaggagaatgacatgaacccgggaggcggagcttgcagtgagccgagatcacgccactgcactccagcctgggtgacagagtgagactccatctcaaaaaaaaaaaaaaaaaaaaatcagctttggcttgaggtttgaagaatgaacccttcagtcatagactatgactacctgtcatagctcactaggaaaccctagggaatcatggaagggttattggttaaatatattatataaaggaacattttgctagttgctattgaccaaaaaggctgttttttttttttttaaatatagtctgtaattatttttgttgaaagatatttggaagatggtttttctcaatctataggagatacagttcgtagccacctgggatctcttataaaaagatactttttcatagtatactctttataatatgcataacatttcataatatacttttgataatatacataaaatttgatacataagtttaccaaatttattgaatttacttcagtgcatttttattagtcaagattctttggaagatatggaaagctaattcaaaaaagcttgagcaaaaaaaatttgttggctcgtaactaatgttcaggactggtctcaagaacttggttgccagatctgtgtttccaggttatctattagcttgtctgtgtctctgtgatagttttacccttttagagtggaaaatcttcctccttgtggtgctctggcttgcagaagaatgcctttggtctagcgccagcatatataaaatcctgtgggtgggatagagtagatgtggttgcatgtgtgctgactggcagtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagtgagtatctgactttgttttcttttaacctgctaagtggcattcgggaaacttccagagagtcatttttaggaaacgttggaaaatatttttaaaaaattcttgctgagttggaaaatggagaagatgagaaaaagttatgtatttgaatcattactgtgtcaaactttgataaatactgtataatgttttaaaaatgttttatgtataaaactctagttttcatcagttttcttagtagagctaaacatactggttgtatgaatcatatatggcagagttgttaggtgtttggttctggcaaactcagattgtttgagttttcctggctctaccaattacaaactgtgtgaccatttctgtacctctatgtcctgatctgtaaaatggagatgatctcttcctcaaggtagctatgaagattgagttacataaataaagcacttagaacagttcccaacatgttaacaatcccttagtaaatattagctgttatgattattattaccatgataatccaagagacatgaacattggaagatgggctgggtatggaggcttacgcctgtaatcctagtactttgggatgccaaggcaggctgattgcctaagctcaggaatttgggaccaacctggccaacatggtgaaaccccatctctactaaaaataaaaattagccaggcatggtggtgtgcgcctgtagtcccagtttctcaggagactgaggcatgagaatcacttgaacccaggaggcagagactgtagtgagccgagatcgcgccactgcactccatcctgggtgacacagcgagactctgtctcaaaaaaaagtaaaggaaaaagaaaattggaagctgcaaagcaaatgtagaatccttaaaggcattttgcactgtaatttattttaactgattcatatcaccgcactgccaggacttctaaagaccctgctgcaagttcagtgccatccatatgcttctgagattggtacagataaggagatgaaggggctgtagggaaataagaggcaaggtggtagggttttaactgagcatttttcttaaaatgttatctgtgaaatacctgagtttcacagagttagaaatgctaatcatctttggtttccagcttcagagtaagaggctgtactatatggtgatattaacattgtttccagtgctaaacattctgtgatgctaaattgagcacaggattttcaacagataaactgaagtatagataatcaacgtgagaatttgtggaattcttttacatatgttaaatgttcactgtactcatggtggggttactcaaaatgtagttgatataaggaacatgtgttctagtggcaaaaaaaatacgtatagaaacattagccattgatgtgaaaaattacagcattctgaaaagataatgtttaaaaagatagtgagctaggcatgttagggcatgcctgtagtcccaactactttagagactgaagcaggagaatctcttgagcccaggagtttgaggccagcctggtcaacatagcaagaccacatgtattaaaaaaaaaaaaaaaaaaaaaaaaagatactgctgctgcataacaggatttgaagcttctatcttacacatagtactttttagttacctggtataggagattatcatgagaggactgtttttttttttatttacaggtaatttctgaacagggaattagcacaaaattttttaaaacagtaaatattgatatctacatgaaagctgatgtattttaggaattttttaaatcttttttttttttattttgtaggttgtttttgttttagcctgttgagagagtctgcaaataaatttaatgagtagtctaaaaactaacttttttttgattgctatatcctagctcttttatctttggctctcttctccttattaggatgtgaagtaattctcaggagaggaaatgcatctagtttttacttgatatcaaggactctaaatcactggcttcagttttatgtaaactggaaatgtaaggaagttggtattttggatggtattttggctggattctacttgatgagtgtttgacccaaggtgctccttatatctggaaaacatttgggattgctgatagtttgggaaactaaatttgtggttctatttcttcaagacacagatagtgtcgtttccacctgatactcattaaatatcagtttgacaagaaatacattttgaaattatgttcttcatttccttcaatgtggagtactaactgtgtttctgtcctttaggcatgtgattgtgaggacctctcccaatcacaggtacacatttacactgaagacacatccatcggtggttccagggagcattgcattcagtttacctcaggtaactcagatgttaatttgttctcttctgtttttgaaagtcatagaatatgaataatctgttcattttaagcaagcatcaccctgtgactgtattgattcatattgaagaaaaatatctaagtattatataaggaatttaaagatacagtcttcttttttttttttttcttttttttttttaagacagggtctcgttctgagacccaggctggagtgcagtggcacgatcatggctcctggtctcaagcaattctcatacctcagtctcccgagtagctgagactacagtcttgtaccactgtgcctgactaattttaaaattttttgtagggatggtgtcttaactgtgttgcccaagctggtctttaactcttgggctcaagtaatcctcccaccttggcctctcaaagtgctgggattatagggtgtgaatcatcatgcccaacctaaagacagattcttaattgccagtttttgctatggctgccttcttttggcttgattttttttccctaatttttaaagattttgcagtaaaatcagtcagctatcacataaagcgtcaagttattttaatgttaactgccagggtaatagaaaagtagaaaacattttatttgtgaagttgatatctaagaatggtgattttataatgtgatggcgttatactaaagaatttggaaagagtctcaaattacaacataatttgctaggctcccataacaactggatgggttgtgattacagttacaactgttgatggattctgtagaatccagagaattagattgcttagtgctgtcccaggcacatcatacataatataaagcaccaagaatactagtctgtatcctcttctcccttatcattttactcaggctgctgactgtccccagtcctaagtaatgtaaatggaattcctacctcctcctagtatgctaatgagcattggttgacttccctgaaggtttagagaaagagatcaaacactcatttaagaactattaggctgggtgcaatgactcatgctggtaatcccagcactttgggaggccaaagctggtggatcacttgagtccaggagttcaagaccagtgggcaacgtggcgaaaccccacctctactaaaaatataaaaattagctgagtgtggtggtgcatgcctgtagtcctaacttcttgaggggctgaggcaggaggatcacttgagcccgggaagttgaggctgcagtgaggcgagatagtgccactgtactctagcctaggtgacaaagtgagaccctgtttaaaaaagaaaaaaacaaaaacaaaaactattagatgggccaggtacctcacgcttgtaatcctagtgctttgggaggtggaggaggatcgcttgagaccaagaattccagatcagcatagcgagacccttgtcccccgcactagtctctacaaaaaaaaaattttttttaattagctgggcatggtggcacatgcctgtagtccaggctacctgggaggctgaggttgggaggatcacttgagcctaggaagtcgaggctgtagtgagctatgattgtgccaccatgctccagcctttgctccagagtgagattctgtctcttaaaaaaaagggaaaaaaaaggaactattgaagatctcttgaagccctcaaaaattacaggaaattttcacttactattccacctgtctgtttgatgcctcttcattatccagaccactttcacgtttgtttctatagattaaaagtttgggatattccagggttctccagcttttacagagttccatttgggattctgattgttagcaatagcttgaggtgtgacagtttctccttgtctctgttttgtaaaaaaaaaaaaaaaaatttccccgacattcactgtaggccagcctctattctaggtactttggcatgtgttagctcatttaattctccaaacaaccttatacaatagctactgttgttatccctaaggactgttgtattagtccattttcatactgctatgaagaaattctggagactggataatttataaggaaaaatgagatttcatggactcacagttccacatggctgcagaggcctcacaatcatggtggaaggcgaaggaggagcaaagtcatgtcttacatggcggcagacaagagagcgtgtgcaggggaactgccctttataaaaccatcagatcttctgagacttactcactatcatgaaaacagcatgggaaaacccacacccatgattcagttacctcccactgggtctctcccataacacatagggattatggaaactacaatttaagatgagatttgggtgggggcaaagccaaaccatatcagctgtctttgggattgaagtacagaacctaaatgtggcttccttgtgacttaaagtctaagcttaacgagcatggtgctaaatttcaggttggccagaagtgggatggggttttacagaagaggtcttctgggggaggtgaagggcagagtggagggaaacaggatgtggtaagaaagccacaagggagagcacttgttgcacatattcacagttcagtgtcttctaaattacccgccacaaagtctgcagtgtttggatgggcaggtgaactactgattttcaaccaaaaattgtttttctcattgttctttggagtgttatcagtaattactaattttgaatctataccaagcaaaccccagattcctgcctaaacacaatctggcctgccttcatacttcttgccattgtaaacagtagggatttgggaaagcctgaaatctagctgtaaatgtctaaaaatcttctggctagtatacaaagagtagccatgaccatctaatgatttcagtccctgactgggtttcaaaatagattttctgaccagttttaatttagtcttcatgaattgaatgtcttcctttttgagatactgtaacaaacagtaaaactaactgcagcagtacatttagaacactgaagtgtgatctgatacagtgaagaccttctgtagcatcatattgtgcaaaggaacatcctcctcagtggtgccagctttactgcaaaaggcaagctttgcacgttttgaaacagatgttcagatgtaaactgtagcacatgctttactttcctagggtaagtaacaaagaaccattactgggtagcttaaaacaacagagatttattctgtcaccgttgtggaggccggaagtctgaaatcaaggtgtcagtagagctattccctctctgaaggctctagggaagaacctgttctgtgcttagcttctggtgttgccggcaatcctttggtgttccttggctgtagctgcatcatttcaatttctgcctctgctatcacatgatggcattctgtctgtgtgtctatgtctctttcttagaaggacaccagtcatatcggcttagggttcaccctaattcattatgacctcatgttaacttgatacatttgcagagattgtatttctaaataaagtcacatccacaggtgttgggggctaagacttcaacatactttggagggggagagcacagttcaaccataatagcataccatgttttgatctttgagtgtattcctaaaattcattaaaattcctctttttctcttgtctaattttgatggctttggttttaagtatctttttttctcctttacagagaaaatgggctgggctttctattgggcaagaaatagaaggtaggtatattttttagccacctgataaagattttctatgtgattttctcacagttattgagatctgtacaattttctattactagtggtcagatcttaaacattcattgtatcagaagactggttacatctatgagaatgggaaggaaatagttatggtacctctgttcctatatcttttatgaagtgtgtgataaggtcgtcatagttcaaggcaaggaaagcaatttatgacttccagttgggggcgtggcggggtggaaagactaagctgctaatagataataagccaaagaactaataagcaaaaagtggcattgtctcaggcaatgtggcaaagttaggaaatggagtatgagtcgtctttagtcagatgattttatgtcaacttcatggatacagtaggggaaggaaagaaaatgcaagtgtaattaaaccagcttttcttctgcttgtctttaaaacttaaaaaaaaattgtatttatagaaaggttgcaaaaataatacgaagaatttctgtatactacctttacccagctttaccaattgtcatattttctttatcattctggctccctgtcttcctctctgggtctctgtctctctctgtacacacacacacacacacacacacacacacacacacacacacacatcttttatcctactcctcatttaggaacctgacaacttgtaattttttctaagttagatggaatttaaacattggggttattttattttattttatttttgagatggagtctcgctctgttgccaggctggagtgcagtggcgcaatctcggctcactgcaacctctgcctccagggttcaagcgattctcctgcctcagccttgcaagtaactgggactacaagcacttgccaccacacccggctaatttttgtatttttagaagagatggggtttcaccatgttggccaggctggtctcgatctgttgacctcgtgatccacctgccttgacctcccagagtggtgggattacagatgtgagccaccacgcccagccaacattggtgttatttttagttagctttttctttgtggaagtatgaacacttgttaaatttaatgagaaagtggggtagtatgtagcttaggtttctaattttcataaattaatttttctaaatatgaggctaagagtacttaaaactttgaatctagatattttctattgtgacaagatacagaaattcaagattataaattttgatgagttgagaaatgtgttttgcggtttaagttataaaagcattcttctgctaacagaaatgcttatctggattgtaaagtcagatctttaaagaagtggctcaaacagacttaataagcaaaattgtaaaacccagtgataggtgggactaaagtggagtaagcttgagggaaggtagggttttggggcccaagtgatgtggatgatgtagccataaagatagaaaactggtttggtttaagtagtgatgtagaccaagataggataggaggtgtggtttgaaggagtgctcaagtattctggaatgggagttccgtaaggtgaaacattttagtcaaatcagtgattttagtctgagggaatcttctggaggaatcatttagtcggtcttctttccatctggcaatgccatattttaagtgttacaggctgatgttttgaccactatatatacacctattattgtaaagtccaagtttattcaaagaactggatacacttattttttgcttataaaatctttcttattagtcttttatattaaattactattagccgtaaaataagaaaacattctcaatcttctttgatccaggatgaaatcttcaggactcttgtccctttgggactgaccatggtgctgactgtggtgctgcctgggatactgtccatggtgctgcccatagcacttgaaattgtaacagtttggtcttttctatttaggaacattggccttaaattaaaatgcatttgaaaactacagtcagtgcattactacagtcagtagtaattatatttttatttatttatttttgagatggaatctcgctctgtcgctgaggctggggtgcagtggcatgatctcagctccctgcaacctcctcctccccagttcaagcaattctgctgcctcagcctactgagtagctgggattagaggcatgtgccaccacacctggctaatttttgtatttttagtagagaaggggttttgccatgttggccaggctggtatcgaactcctgacctcaaatgatccacctacctcagccttccaaaatgctgggattacaggcatgagccaccacgcctggccaatattttaaatatacttattcaaatttctcagtatgaagatgacatgaatatatgtatatacacacatatatatgcattatgacattatgatattgttttggtgtctttaatgcacaaaatggtattatactgtacaaacctttctgcagtagacttttgtcactcaatattatgttttcaagggccatccatctttttttgagatggagttttgctcttgttgcccaggctggagtacagtggtgtgatcttggctcactacaacctctcctcccaggttcaagcaattctcctgcctcagccatctgagtagctgggattacaagcactcacccccacgctggctaatattttctatttttattagagatggggtttcaccatgttgaccaggctggtcttgaactcctgacctctggtgatccacccacctcagcctcccaaagtactgggattacaggtgtgagccaccacgcctggccaggccgtccatctttaataaatatacataaagttggtttttgtttttttgttttttttttgtttttttgacagggtctcacttggctggagtgcagtggtgcagtcgtggctcactgcagcctcagtacctggctaattttttaattttgtgtagagatagggtttcactgtgttgcccagtctggtctctaaatcttggacttaagtgatcttccctccttagcctcccaaagtgctgggattgcaggtgtgagccactgtgcctggccaagttttaatttcaataaaaattgctgtaaagtattctacattatgaatatactacattttattcattgttctcctactgataaacatttttcaatgtttaagtactataaataatgctgcaatgaacctccctgtagatgtgttgttagacaaatgttctagcatctttctgggacagacatctagaaatggaattgctgaatcatcatattcatttttacattaatatttcaacctataaatgttttcaaactacatgagggaaacaactaagctcttttgcctatcaaagttactcagcatataacctgtactttctaggattttttttttttttttttttttgagacagagtttcactcttgttgcccaggctggagtgcaatggtgcgatcttggctcactgcagcctcgcctcccaggttcaagcgattctcctgcctcagcctcctgagtagctgggattacaggcatgcaccactgcgcccggctaattttgtagtttttagtagagacggggtttctccacgtttgtcaggctggtctcgaactcccgacctcaggtgatccgcccaactcagcctcccaaagtgctgggattacaggcatgagccaccgtgcctggccattctaggaaatgttaagaaggagcaagccatccagaattggagacaggagagtattctgaaacttttagccaaaatttgaacttattatttgatcttcagtgagttttatgttccttcctcaggctttgttattttgcttttgaagtagttaaaatatgtatatgtccccctttaaatacagaaatctgattatacaaacaatttcatttaaagagtttacagaaaatcggccgttcgtggtggctcacgcctgtaatcccagcactttgggaggccaaggcaggcagatcacttgaggtcaggagttcgagaccagcctggccaacatagtgaaatcctgtctctactaaaaatacaaaaattcgctgggcatggtggtgtgcgtccgtaatcccagctacttgagaatctgaggcacgagaatcacttgaacccgggaggtggaggctgcggtgagttgagatcgtgccactgcactccagcctgggtgacagagcaagactctgtctcaaatataaaataagagtttacagaaaatccttgtacataactcaagggtctagaatttaagaaataagtttagaacagaatttagagtgtgaaacgaccataaagacttatctagttcagtcttgatttatagatgtgacaaatcaaggcacagacaacttaaattatttacttggattcttctgattgctagcagaatctgttgaaacacacatactcaaagtccctttgaagaaaacagctttgtttgtaaaccactagaatctttgcaacagacatttaatactgcacagtgacttcttttgtttacctcttgctatttgacctcagtaactcacagaaatgccatgcctgttgttcaaagcaagtgtgaaaaaacagtctttgtttataacctgcttttgtggtgagaactgtagaagctcacttacccaatgtgacttggactggtaattaagtgaaaagttggttaaaggctttttcttggaggtgtggtccatggattggagttctgtattatcttttgtgcatacactttacccataatttccaggtggatttctttgaaatggctggagaacttagactttgtagagcatctgagagtgccaaaacctcttggatttttgtagagttcactcccaaccttttctaattttaatgcttatacctagttagcagtattttttttttctagaagaaacacttcatttaaaaaattttcccaaagctttcaacttataatatctattctagaatgtcaaagtcattgtaataacagttcaacaaccaggccttcagaagtttttatactatttaattatatttcataattaactgtaacaagtgtaactagcacagacagataccagaatgaacttggttgacccatgatgtgtagcaactcctgtctacaagctctgagcgttaggcaaaccataggctgatgggtatatgttggagggataaaagttggtcagctttctgatgactcagctcagtggaggttgcttacgagagctgctactgtatccttaaggggccattggtaaattttaggacaagtatcttcagggaacctaaagggaaaataaatgtgtgtgtgtgtgtgtgtgtgtgtgtgtgtgtgtgtgtgtgctcgtgtgtgaagccttattgaagagtagcaatagactctttcttactaggcgtaatcaagttgccctcctggggaaactcaaatgcaaaaatcctcttgaacttttctgggtagcctactctactctttcctaatagtaccactacagtatacagcactgtaaaattttttgctttaaaagtttgtttataaactggcatttataagtatactttttgagctgatttaagaatcaagtttttttttctagggaaatgcttctttgtaattatctgtcactagcaaaatttgttttaacatatatttttctaaaaatatgatatgtaaactgtgttgtagttgtacaattaaaggtttttggtcgaacagttattacatgatgtaaaatcatgtgtaacactttaatattaattacattgtaacctaaaattcattttaaaactttttatgtggcttgaacaggaattttcttatccaaagctttgtatgtatgctttattgcctcctttgttattagcatggagaccatgggttttctgttattgttgtttcatttaaacagttcatgaatatattaagcacctgaaagaaactgttagatgctgttaataggaagaggagttaaaaacctcgtccttgcccttatctacatgtgtacatgtagaacttactgtagttccctagatgtagcaggtgctcaggaaacatttttgtagtagtaaaaaagaaatgtcaaactctaacttgctctggagcaaattccgctagtaaacattgtttttcaagcttcttttttttgccttgcgtcctactttcttaggccaaaataattcatccacatcccaccttagctgtttttttgtgtcaaacaaaaatcttatttggaaatagcatgttatgccaactgtgttggggcatcccatactgtattgcattaaatgaggagaaagatgcagaggccatgtggggaggattgtgatcctgataagagtgggatgagggataacaacagagagactgccgttcaatatttctttctttctttttttttgagacggagtctggctctgttgccctaggctggagtgcagtggcgtgatcttggctcactgcaagctccgcctgccaggttcacgccattctcctgcctcagcctcccaagaagctgggactacaggcgcccgccaccacgcccggctaattttttgtatttttagtagagacggggtttcactgtgttagccaggatggtctcaatctcctgacctcgtgatccgcccgcctcggcctcccagcgtgctgggattacaggagtgagccaccgcgcccggcctgccattcagtatttctaattaattcagatggggaagaaaatctctagtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctagtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccacctcggcctcccaaagtgctgggattacaggtgtgagccatcacgcctggccaaatgaggaatttaagatctaaagaaggtaaatggtatgcccatggctacacagctaagggacatagttgagataagaattaattaaacacatatttgatagtacctagtgcctagtaccagtcactgttttagacactgcagatcggcagtgaacaaaatagatatgatccctgctgtcatagaacttactttctagttgaagaaaacagaaaataagacaggaataccatgtacagttaggtctctgatgaaagtagatcaggacaattcaccagagagctattgcggtgctgttgtgtattggatgaccaaaattgtgctcagattgcctagctaaacttgatggtttttacctttgcttttagttttagtatcctaatagaaaatgtttaggagaatgtttaatagaaaatgctttggtatttataataatttaaaactcagtagcatgtagaagtcagtaaatccatgaaagagaatctttcgtaattcagagaagaagtaaatatcttactccagatcactgtccttaactgtttcttctcatttgtggtatctcgtagtagcagaatggacagacagcccaacctgtaatatttaccattataccccagcacatagaagaagaccaaacttttagaagggactcagcaaagatttggtgaatgagtaattgagcattcagaagctgtctctgcacttgtagggcaagcattttgtactagtgatagaaaagcaggaattgtagagtcacagacccagggttgacttctggcgctctcatttactgtgactttgagccttgttgcatagcctgtttctgcatctcagcttcctcactagtaaaatggagtcgtagtttctgcttccaagagtgtttgtgaatattatataactggctgtagtgtttgaataaaatactaagaaactttattctttgttagaaatagtaaatgtggtactcttgaattactttaggtggcactctgacatttaaattagatattttttatccatgtggaagaaattttaaacatgagttttgcagtcattttgtaaacactgatcgtaagtgctaattcccttttcttcattggctgtgagtagtttgtttgaggagcagattggagaggagtatataagataaactggttttctgcatttgaaaaacattggtgatgatctgaggatcaaactattatattatgaagtgatttttctccccttacctcttttctacatagcttgtctttagcttcaatgaaaagctttttggcttactggtgaaggacattgaagccatggatcctagcatcctgaagggagagcctgcgacagggaaaaggcagaaggtagcttttatttctgatcatctttactagatcatctttataatgtaatttgtgcagattgattataattttcctatctgttgcttagtgatttttttcatattgtgtacccttttaagatagtagggagaaaaaattgctttcatagccatcattgttattaaaatatagcttaaaatgtatttatttgcagacctaatattaatgtaaaatgtagacgtatatgtacatataatttgcttgaatgcagatatttattgtaaataaataataagaaacgcattattggaaagatataggcatggaaataaggcatgtaagaattgtagaagaaagttatgagaaaagtaaaagtagctcagatgatagtctggaaggtttgctttgcccagagagacctcatttccccctcacttttggccttgctttgagaagtccagaagtttgctattagactactaattattgtctttctctacagattgaagtaggactggttgttggaaacagtcaagttgcatttgaaaaagcagaaaattcgtcacttaatcttattggtaagatttacagtttttagaagatttgaaatgaagtgggcctatttctatatgtaactcaactacagtgatttccaaatggggaaaggaaagaggggcatctctcttgagagagtttatcacagaagcatggggtatttcctgttggtcagtttgctgatgaaaacgtttaaaaccttcatctggatcaactttgtccaatagaaatagagtgtgagccacatgtgtaatttttaatttcctagaaattgcactaaaataagaaacaaattaattttttaacttttaattttgagataattttaggttcacagatttgcagaaatagctcagagaatttctgtatgccctttaccagcttaccctgatgttaatgtcttatttgacattttcaaaagtacaatgataagaaatgaacatggtttcatttctgctaactaaactacagattttattgagatttcaccagtttttccattgtgtccttttctgttccaagatctaatttaggatcccatattgcatttagttgttctgtcttttgagttttcttcagtcactgacagttcctcagactttgtcttttatgactttgagaactggtcagttattttgtagaatgcccctcacttggttttgtgttaaatgagatagcatcatcatttcttttagtgattaagtgatgaatgtgcaggtcaagtcttcccagcagattcatggttcagtcctactcttgtactctagcacaatttttgtcatattaaaacaattgcagcttattctctgagaatagtaactcaccagaataatgtgacattaactgggcattaattcttatttttggttgatttaactatgttgatgtctaccctactagagagtagagggttttcattggttgcacatcatcatgtccagggtcacttaacagtctttgagtgcgtggcctttatttcctggtccacaaattaccattcccccttattgttttttgttaattataaaatattttatttataaaatatggataggcattcgaaaacaattcacacactgtaaaatttggttctgttttcatagttttgtaatttgctttttttgcttagcatgtttcaaacatcttaaatatacacctataacatgatttttaatgcctgtatgtcattttatgaaggtaggatgtattttcctgttattgatctagtacatttatgaagtgacttctttgtattttatttttgtgtaccttttgttaagatatcccaagggagttgcataactttcataggtatttctaagtaatccatgggaaaaaaattgtgtagttaattggcattcagtaaattttgcccacaagagggcagtagagtgtaagaaaaaaatatttttcatcgctttccaaaggaaatcttaaggcctcaaaactctaaccataaaattatcatctagtataaacttttaaaaagcgttactttatttttaattgacagataataattgtatatatttatagggtacaatttgatattttaatacatgtatacattgtagaatgatcaaatcagcctaattaacatatcacctcaaatatttagcatttcttaggataaactttttttaatgtgacattttcttccctggttttataaaaaccatattattactttattttttgtttataatagagcatactaaggtacttaatttattctttgtttgaaatagtaaatgtggttctcttgagttactttaggtggcactctgacatttaagttagataatttttgtcctcttgagaatttttaaacatgagttttgtaatcattgaagtctttaggatgatttcagacttttgtgtccaagtgaagagaaagcaaagaagacatcaaacttgttcagtatatttccttaggctgaggggttatatgcccaattacctgtataagcttaatctggataaatatatgtattttaaaataaacttgcgttaggagacttcagtgactgcgagatttcagttgcatttctgccagctagtgttgtcttcatcagatatggcatttcttctgatcaaccgagttagttaatttagttagattgaaggttaataaaactaagttttatggactgatacaaatagactacagcataagtttagctagtcattttgacagtgtgttaccatatatggagatcagacaaagtagatagcatagcaaaacttacccttctgactgtaaaatcagctaagattatattgttcgttttgtatatgtaagggtagcttttctttattcatttaggatgctcagggagttctgtctgtctttttagacttagtgataaagtccttgtttcacatttgataatattcgtttgacataggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggtaagtttaaaaaggaaaatgttataaaatcttgtgttgttaaaaaaattaatgcaatgaagaatctcttttcaatagttttgaaattatttttcagacccattatttttgtctttttctttaaaaatgaacagataaattttctgaaaaactttataataccagaacttttaaaattacattttaattttatggggaaatcatagaaataagacttgtggtggctccattttgtttatttatttattgaagaatgcttttctatggggcatatttagaaacttcccctgacagtaataatactagtagtgactccattttatttatttatttgcgtaagaatgtttttctatagggcatatttagaaagttcacctgactctaaagatcactatgggtcagatgtaccctgctgaataataactatctattaggctgtgtgcattgttctgacattagctgccgttcctttttattgtactgttgcattacccagttagtacatcttcatacctaataaatgggtacttgcatatttttaaattaaataagtttgatccaaaaagacaaatgcaggatatacattggagtttctatattgcatacaaagaagtgcactattcgtttaccactttcttcttgaaggtttatttaatttatctgtgtgaagtgactttatttgcccagtggaaatgctgtcatgactgttttcatgtccatatcattcgttggattggaatgtgagcaacagaatatctgagaaaggaatgtataacataacagcttctggcagactattagtgtaaaaacagcatccaaaaaaaaatggaaggaatatgaatatattactccgctcatccccatcattctttatctttaaattgctactggaagataaaagtatatttattatagtggggataagaactgctttctaggcactaagtgcttggattgtattagccttctattgttggtagcctttctgcctggtcgctcactctgataaattacaggcacggcacacacctgttcactgagtaaaggtcgagtttggaattggattaagagaaaatgacagagaccctcatcacctgagttttatacaccttgaaatggcaatagcatactttttatctcaaagatacaaaggccacgtccattaaaagcagaattttaattgggaaaatattttaaaatgtggtagttcactatcttggtaatgtgtattttcgatcaagacatgaaaatattgtttaagtgtattttgggtaaaagcagggataaaaagatgattccaaatgttgtaagttattcttgtggaatgtttttactggttttcagaactgagatctagtgcaggaagagtctaatgattctgtttcttagaacatttatactgtttagccaaaaagtagaaaaataactgcattggtagtaagccgtctcttttaattataaatgttttctcactgtttggaagctattgaagataacagttattcagatactagtttgctatttgtgcattatctagatcctgcacttgaagctacgcgcaacgtcagtatgcgttgggtagataatgcgtaaaggagttggtctcacattggtcagtttgtgaccttgccagctgttggagagttttaaattaaatcagaacagatttggaatttgttagtgaatttcatctgtttctgatatccgtattgaaatgagctgaattacagtagtgtgctttttgttgtttttgatgtgttttttgactaagcactatggatttgaattttgtgagtgccactgtccagaaccttttttatggatttatttttctaatatttttacactaatttaattagacaaaaaatgaattctatccttttggaaaagttttttttttttttctctttatggctttttgccatcaggaagcatttgttaccaatttcattgaaaagacaaactagtataaagctgtcctggcttttgagctgaattgaaaaacttattttctttattctggatgaagtttctgggtatctaaaaaaaagtaaagcttcttcttttttttttttttaatggttaaatggctgagaaataattcttttgtaatgcatgtataattccctgtcttccaatagaggcttcttttttcctttgaattttgggggaattatatagtaaaatcctttcttgcactccaattacagtgtggttataaagttctccttaggctttggtaaaggtatataaataaaaatggttatattttgacagaatataaataaaattatacaaattatttttatgcatattctgtgttgtttttttttttgacatgtcaggtgggaacaacatggatttttttcccccactctttgttaactaaatagacagatctatatggtttggggattcagctggacactgagtatgactggttaaatcagttctaatttttaaaaaagattagaaaagaataatttatgtaggttatggggcttttttgttttaagcagaaaactttacttttggcttgagaccaaattactgtctttaccatggagtctaaagtgatgtctacttcgtaaacaggaatcttaactaagtggattttttgcctatatatcaattttcaaatttacaaagtgataaatttagaatattcttctcttctgtcattatgttcatcagactgataattatgcttctaggtaacagagttctttctttttgtctataaaacttcatgttgccttttcaaaattgaaaaatatagtttagctacgaacagaatgttgctgatgagatataggaggactaaaggacttaacgagaggcacacaattaagcagtaaaattagggaaccaatgaggtaatatacttgaaaataactgtcatggagtttccaatctgttagtttctctcttgaaggtctttcaaataggtagtgtataccttaggccgggtgcggtggctcactcctgtaatcccagcacttagggaagccgaggtgggcggatcatgaggtcaggagatcgagaccatcctggctaacacggtgaaaccctgtctctactaaaaacagaaaaaattagccgggcgtggtcgcgggcgcttgtagtcccggctcctcgggaggctgaggcaggaggatgtgtgaacccgggaggcggagcttgcagtgagccgagatcgcaccactgcactccagcctgggcgacagagcgagactccatctcaaaaaaaaaaaaaaaaaaaaaaaaaaaaaaaaagaagaagataatgtatgcctttctgcttttgtagttttgttatatttttgtagaattaaaatcaaggaaacccttaaaggagaaaggaagtcacataaagctctctagactgagggataaaggaaaagggattatttaggggaatatcaatttagacttttgtttttgttattgttttaatcagagcaactgttgagttttccccttgtctgaagcagttgagctcacccaaacccaagtggggcagcccttccttggaaggatatgagagcaacgagcgaagaaaactaaacctataccttgcacttagtaaataccaaatagatatttagttagaatgccttccaaccccccacaaaacagatttttaattaagaattaccttaaatccataattttatgggctaatagaagccacatttgagtcccagggtagaaatgtgaacatcaaagctggtatctggaagtatgggtgaataaattcaacagctgattgctgtctttcagcatattcaggtgttaactgaatagatactgaatacttgtgttcggacatttaccacacttattcccctgtatgcagttttgtggacagtgttcaggataaataaatgattgattacctcagttctcactgtagctattttgttagcaaagatagcgtttctgccaagaaacttcattttttcagcatccctggcaattctctctaaattataaatgtcaaagcaaaaaaacacatcgttttcaatgaacagtggaataattgttaaagaattagtcagcatctcttaatgtaatcctgggaataggttcacatctacccaaggaaagacctagaaggaaaaggatgtaaagagggaagacctcagcctcacactgtctttcagtggatctgtggggtgtagatgttcaggccacctagtggggaggaaagccacttgttatggtcttgtgcccccattctttgaaactgacactgtgttctttttggtctcctttccccagtgtctccctctgtaagcccattttcaatcgtatttttaaggtttcttttgaaattcaagaggaaagcaactcttttctgatatcataagtgaaattgtagttactctatgaaacagaactgctgagaagataaggaacctttcaatcacacagacatctttcacatactaaaaacagtgcaaataaaacatagtggaagaaagggcactaaggttttgtgcatgccatattttggagagagggagttcttgctaagattaacataaacactgacactcttaaaatgcattttcacacccccactcatgaggagagattgcattttaaatgggggttaagacatccaggcgaactccagggctctgtaaaaggaaccctaaggctaaagagcttatctgaaatttgaaaaaaagaaaaaaaaatgaagccttctgacattcatctttttttcttgtattagtcataacttgcttttcagctatattttaggttttgaatgccaacctgacatctgttcaagtctgcctgtaatttattagcagaggaaaagacagcagttgctcactagttagagatgcaaaatttctgccttcctgttctccactaagtacttatagatgatacctggatacgaagaatgtaataatttactgaaaacttcaggtcaggaaatttataaagatttttttttaattagaagaataaaatggcttaagaccatgtgatttcaaaaatctctagatcaggatttagagacaaaacatagaccctaaaaaatactttagataactttctataaattgtaatttttttaaccttgaattaatttttccattggttttaaatttttaagttaaatgtatatttgaacagtagttgtgcttatatctgaaagtcaaactgtatgtaaattcacctggcattttgcatttatagacagactttaagaaacaaatcttttggagaggtagtgctgtctacagagtcaccaaatggattagatttcctggcaactacagttgagttacttacagatcaacagttgggtcactacaaagttgagatctaagtgttaacctgagtgcccaccagtaagaaaccggttagaggcaatcttaaaatgatatagctccaaatgtagagacatgtttgtgttaataaaaaatatataaaagcaaatgcattctaaaaatctctaaggacatacattaaattgaaaaaaggtttatggctgaatgtggtggctcacacctgtaatcctagcactttgggaggctgagatgggaggatcacttgagctcaggagttcaagaccagtctgggcagcatagtgagaccttgtctcatttatttatttttttaatttaaaaatttaatttaaaaattaaaaaaagtgtttacttccatggaagggaagctaagatggggaataaagggaaagttttgttcttttactcaattttacctttatgtctgaatgttttattgtatttctaatgtgtgattttaaaagccaacagacaaaagataatatcacagtatgtttcttggggtgactctaccatcagcatggaaagtcagcaggaaacaggtacatccttccgccttcatgaagttttctgtggaggaggagagtgcagggtaaaaggcctggattccaagggctttgctggcagccccttagagggtagacagaacacctatcctatttggtcaagaagagaaaaagtttctccatatataacaaactgctttcccccagaatgttctgcattatagtaatggtgtaagtagtctgcccttcaaacatgagaacatttgcatccaggcctttaggcagccaaggcagcattaaagaagaaagagtgggagcagagcgagctgagggagagcagagcttctgacatttgaggaactgggcgtgaatttgtttttagtcttcaaaaaccattctcttgaggaatcgaattcccatgactcctgaagtgaagcggttggtgttttctcctgcgttactcccatacgtaagttggtgattataatgagggtggtggctaatacttatataatgccagacgctgttctgtgtgctttattattgtgtttattaatcctcacaacaaccttcagaagtagacactgtattgtctccatattatggagcaggaatctctgtctcaaaaaggtgaagtaatgggtccaagacacacagctagtaagtagtagagtcagatttgaacccaggcagtcgagccccagatttcatttccttaaccattacatgttattctcccatgaaagcccatcgtgtaaaaccattttaatgggctttctagcttcacttttttggggacctttgaagcaatcattgaggcagcctttgttctagccaagggccaaccatggcaccattgagattttgagctgtataattatttggtctggggactgggtgtcctttgcattgtaaataactaacttttctagtaatctgatgtgttcaaattgtcatgagctcaagagacatgaagatttggtggtaggctgtaatacctaatgccacttttttcatgtgttttttgtcacgtgttgtagcagaatacaggaaggaaggaactggaatgggtgtgtcagagaagctgtcttaaactgtcaacctggagagggaacataaatgttaaaattaaataatcattaaaaaattaagcaacgtaacaagtgatatcaaaggccagtatttgattaagtgccagatgagcagtacaattgataagccctacaggaactgaaagggaatcacatcgagaagacttcatagaagaggcagagcttgagtaaggccttaaatgctgagcggttttggataggaggagggaaggggatagttgtccatatcctgggaagagtgacagactaaacacggtatagacttcatgacttagaccagtctaacagagctgttgtttggaagaaacaggaaataggattaaaaagttagttttgggttgggttgtggaaatctgtgaggagatgtggactctttttaaagtactgtccctgtttaagcttccagacagactcagaaccttccagacagactcaggtgcttctcctgtgtttccctgcaccttgtatatacttagaatccagctgtgttcttaatgtaattattcatttgcattacactcctaaggcagaatttcttaaccttggcactattgacattttaggctggataattcttagttgtagggcgcctgacctgtgcatcataggatgttaagcgccatccctggcctctacttgatgtcagtacttcccttcctcaccactccgagccccagtgacgattaaaagaaatgtgatgaaactgtcctgtgttgagaaccattgctcaaaggcctttgaaggcacaactgtaatgtcttcttatccatgtattatcaacatcaggggtgttgggatgtaggttgcaggtcattgttggaccatgaaccactgttaccagtccacaataagacaaatattggaaattaagaataagtaattacaaatgtttatagcaatttgacattatcacaatttttttaaaattatattttacaaaaatgttggtctgcaatggattggaaatttaaaaggaaaaaaaatacagctggaccttagcatacatagtttgagaagcactggcctatgtaaatatttgcaaaatgaatgaaattttttgaacagatgccttagagaaaaggtgaggcgaatagtcttagagaccagtagactattgctgtccagtgtgtggtacttagaatctggattggggtgaaggcaacaggaatggaatgggaagaaaatacatgaaaaaattgcagacatgaaactggcagaatttggcaatagttattgtgggtgacagaattggaggtgagactcaggtcttgtgagaaaatgttggaaatgagaaactcaggagaacatagttttggaaaagtagagaatatcattgcacatattttcaatatcgtgaaaggaaactggaagctgaactgaagagaggaagaattactggcatttcaatttattgaagcctagcttcaatcagtctgcacgtgtttaggaaacacactgttgactacttttgcttgaaataccctctttacttggcttttctcactccaagcatttctggttttccttttacctctctggctgtctcttttcaacctcttttgtgtcccttaaaatgttggggttcctcaggagtctgtctttgacctattatttttctctaattattctcctccaaattaatcacatctgtttcatagcttcaattagtatctttatgctgctaactctcaaatatgcatatgccacctcggtctcagtttagaactctggatttgtaccagcataatgtgttgggtatttcatgatcacatagtaagcttgaaattaaacacattcagttgccccctcagtcctctctaaacatgcatctatatctgtgttttctatctctggcaatactctagccaaaaatctggacacctttaactcctctctttccctcacctcccacttccagtaagtcgcagaatagaccgtcaattctgcaatctccgcaatctctctgaaatccctccagttctctctacctcgccctgccactcttccttcaggacaccattatctcttgcctgaattgctccataagccctcagccttgcccttctctaatccattctccacactgtaactggagtgatttttataaaaaggcaagtctgatcctgtcactgcactggttcaaactctttagcagcccgccttaactccttacatggtttacaagccctgtgtgatctggctcctgctaaactttcttgcttcgcctctcagcccgtgcccctcccccatactctgggttccagccagcctgtgctattttcagttcctctaatttgccatgctactttctcttacctctatatcctagggttatttttttttgctttttttttttcttaaccatcttttcatccaattcctgttcactcttcaggccaaagctttgaactcactgtttctagaatgagtaggctttaatgttcctcatgtgtgttctaatagctccatgttattttatgcattattacattgtattataattgcttattacatgtctgtattccaagtcctctctccatgtccctgccctcacaaacatagtataccttcagtaaggaataggccttgtttattttggtcactgtcgtattctctcctcccggcatggtgtctggcttataagttttcaggaaataaataaatgccaggaacttgattaatcttgattaattaaatagaacacttagacagtttgatccaagccctgccctcatgatacttacagtctgtgtgggagtaacactgtatttgcacatcccaaagcagtactgtgtaaaacataaggtgcattgtgaaccagattagcaaagtaggccacatggagaagcagcagatgcatttaaagagcaagactgagccatatctttaaaagtcaaagcagatatgatgtttataattcattactaaatccatgtagatcctcttagattctgaatttaggaaagacctcttggattggtcctgaatggcactaggctccagaaataagaaaaggaagagtattttcttgggtacttgtgagctaccatttgcttcattgggaactgccattcttatgtaagggcactataacaagagtgttcacatttaagggcatcaggtcaatattgcgtctgtgtgagtttgtgtgcatgtgaatgcacacatgtattttctatttttaaatagaaacacattataaaaataatgcatcctcataaaacagcacagatagagtaaaaagtgaaatctcccttcattctacccactccagttttactccctctcttagaggtagacactgtaaagagattggtatgaatttttcaaaccctttcctaagtatttatacaataatatataatcaatccattcattcatttattgagacagggtcttgctctgttgcccaggctggagtgcagtggtgcaatcatactccgttgcagcctcgcactcctgggctcaagtagtcctcccacctccacctgccaagtagctgggactacacccagctaatttgtgtgtgtgtgtgtgtgtgtgtgtgtgtgtgtgtgtgtgtgtttgtgtagaattggagtctcactatgttgctcaggctggtctcagactcctggcctcaagcagtcctcccgcctcagcctcccaaaatgctgggataacaggcatcagccactgtgcctgacttttttttttttttcaacctagtagtgtatcttgggtttttttctgtgataaagcacacagataacattttattttttaaaaagttaaatagtattagcagatctgcatccacacaagtcccgtcatggtaagttagcgtctcttcctcagcagtaagaaggctcctaggcacacaccagaacaaggttggcattgcgtctcctttctactcacttgtatggccctaggcttctcaatgcggcagggccctgggcgctcagctacttgagccttggtacccttgcctgaaaaattgtttattggtaggtaacattaatgtgtgtaagttttctaacacagtacctggctgactgtcaaacactccatggatgatagttacttggtatgattatattgccaagaggcacttttggagctctgtaaaaggcaaaaatttataacccaatccctttaatctaatgttaagatgtgttttcttcttatcttaaattttgttgctgttgaaaatagttaacacctgagattttcctcctatgctgttttataattacccattttgaacagtgtttgttgataaggtagtcaaggggacacttcgaaatattttttctttatttgtgaagtcatactttggctgatttatatttaatttttatcacattacatcggagaggagcagataaattttctatcacctctataaattttctatcacatataagaaagtgtatcttatatgtgatacactaacttggaaaaacaacagctatcttgatagacacaatagagaataggatgtcagaggaagagaagaattagaatgttaacaataatgctagtaaaaagctacccaggacttaaatggtattatttgagagtacttctaccatgattcaaataagacttgccttggaattccatatgatttgttacttagagcagtctacctttaatatgtttaatatggtcatactttaaaaaaaaaaacctgcaagaaacttgggtttcacgtttttgctttttaaagaattaacataatgttatttcaggtttgtaaaggaagttacagaagatagcaataaatcccttccatataccattttagtcatagtgcaaaattaggcattgaaaattattatgggtactgtattagatattcaaagatttatttgtggctttgacttctttaccaacacctctggctttaatacagtatcttttatcagagcaagtaatagtttgaatccttttcttacaaatcctctttttactcaagtgactgcaaacttataaagatgcacacatctgtagcttgaacgtctatgctatttgctcaagtatttacttgaatttatcctcgatgatatgattttttgaagtgctttgattttaaattctatctagaatcccatcatgagggagaaatcttagcaagacttaagcaccttttcataatgactggttactgtaggataaacctataattagtatgttgctaatccacacgttagatatatcccatcaaatttcaaatatacacaggagaattatccacattgaaggttattagtgcattccagggacatttccatgttgattcacaactacccctttaccttacactttcctgtgttactagacgtctctttctgtaaaacttctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaacccttttttttcatgttatctagaaatgaatctttaaaaaaaaaaaaaaaggaatgggttgaacttataatattttagcaactcataaaataacttgaagaaaaagatcatttggaaggagagacaaaacagactgaaagacattgtttaaatttatgacttttattatcttacttgaatgctatttttgcccctctcgctattattaaaccctttgcttcctgttttcagttgctcctgtcaaggtatgaatttttctttggatgattgtcatctatttcatattatctagtattcctctctattatgagaaaatcaaaagtagacagtgtatctatagctatagatttaaatgcactaaggtaattatatatttgaatcagagacctaaggaataatctagtgtagcatttaccaaatttatttaaacttaacatgcttacatgaagacagacctatttatgtttccaaggaacaccagtttgagaaatgctgatcttacctgtgtcattcttattttgtagatgaggacattgggacctcagaagaataaggcaacttatttaggctaaagtcactgcttgtctactggggctggaatccaggttgcttagtctggtgccctttaggcttcatgattcagccacttaagacaatttgatttattgttgggctttttaattctagatttcataacttggatatgaaactgtacttcccagtctccaaaataagcttcactgttttctggaacgtgaattagattcagaaagccccttactgcctttagattattgcagcctccccagtgggccccagggatccaggaaaaatatctttgtttttcacctagtcctctcctcagcttttagagggactcttagatctatgtttatgaaaagacttttattagttcttatagttgtagtaatgcatgtttattgtagaaaatttcaaaaatgtagatgaataagaagaataaaacaatcactcagtgtaaaaaacaaaaaaccctgaaaaagtaccattaatattctggagtatatcatccagctagttttagctgtatatacatagaaccaaaaaaaaaaaaaaaagcattttgctgttttataactggttttctccccactcagtaagttaacagtttttcttaaatattctctacaacattctttattttgtagaatgataatgctgtggtttgtttaatcaatcccctctagttagaaattgtattcagttttttactattatacactatgtttaacaagcaccttagaaactaaatatttctacacattcatatttctttaagataaattcctggaagtagaattgctgaatcaaaaaggattcacaagtgtaaatgtttttgacatgcactgccaaatttagacttcctttttgaaaagtcaaatgttaaggagatcaaagcaatcactaagcaggtactctggaagagaaatagaaatataaaaaatataatggtttcatgagaaactaatagacaaggtttcaagagacttggagtctagttttggatttgtcattgaatggctgtgacttttgggtcttagtttcctcattataaaaatgggaagatagactagaaatagaaactttttcagaatagtcaccttatgaatgttgtttcagtgaaatataaaggtctgtacataagttctgcagggaagatgccatgtatttgctcattcttcaagtttcagcttgattgcctttggaaggtctgtcacacttaacgtcctcctaatagaagtaattgttttactttttggctcctcatagccctttttaaatgttggttctgtatagttgtatctttgatttttaatattgaggtatttgtaacagaggttatcttactcatctcctgaaagcacttggcttagcatagttcttgggtatataatagagactcagtaagtatctgtggaagttgagagtgataccttgttccccagtgtataacagcaaagcctagcctcctcctgttgagcattgtctgttctcgctttgaagagctcaccacatttcttcagtttgtttttgtttttattttattttatttattttttttttttttggcggggtggggtctttcctattcagtaacacagtggttctcagtctttggtgtgtatcagaatttttttttttttttagagttttgctctgttacccaggctggagtgcagtcgtgtgatctcagctcactgcaacctctgcctcccaggttcaagcgattcttgtgcctcagcctcccgagtagttgggattacaggcacatgccaccatgcctggctaatttttgtatttttagtagagacagggtttcatcatgttagccaggctgcccttgaactcctgaccttaagcgatccacccaccttttctggtattacaggtgtgagccaccctgcctggcccagaatttttaatgttaaaaaaaatacagatttccaggctctcaagtacactgaatgtgagtgtcaggcacaaagccgagacacagcgctgtcaatagctgagctctccttggggttttagctttgtcaggcaaattgatattcaagttccaggtctgccacttaccagatgtgtcttccccttaccaggggaaggtcactttaccactgtaagcctcagtacctcttccttaaaaagagggtaaaaataataccttagctcatagttttaaaaatgattacgtaagagaacatattaaaacacgtagtatagcccttcccatatctgcagttctggccttgatctgtaacttcttggatcttatatgcatttattatttatttgtttctttttaaaataacatttatattttttcaacttttagaggttaatatgttcattatagaaaactgaaaaacacaagaggcatataactaaaaaatcatccataacagaatcagtttacattctgatgtatctttccagtccttgtatgtgtatacatatatacataactgagtatacctttttacatggttacacttatatagtatgtgccatgctttcttgcatatcatgagtacttgagtatcaaaatactcagggctttaggattcagacattggtaaatattcacgatacattttcttatcttttgtggggacaaaaatatcttaaaaaacaaaatggcaacaggtctctggaaatgcatattggcaggtttatagttaaatactgtgttcacttaatacccaatataaaatgagatacaaagcagtcaagtaagtataatgcttcttagatagttcagtatgagatctgcactattaaaatattaccagaaatgatgtttctacttaattatttaacaattcatatagtattcacaaagtataccaagaaaaaagcacacatatgtcagtggttataatcagattgtaaatatggacatatctatatatatctcttcccttacctttctttctgccccttccttagcaatccagtacgtactgatgtatactgctcataggtggtttaacattgccatttccaagatgcttcttttctaatgaaattaatttactatctagttaattcactagctctattttatacattgtcacctcataacatctagaaagcttagtgttgtgaagtaaggactgataaacagaggcactttactaaaaaatcacttcctagaactgtggctacaatatgaaactatcttctagatatgaacatacttgcaaagaaccttccttttgcctttcttcttccttcttcagctcaatgaataagtacagaaatgcatatagctctacgagatgggttaacaacagtcactcccagacaacaagccttgctaaaaactctaacaagaggacatttatcaaagaatcattttacttcttaaactttcagcatactttgggcacttctcagcattggggccttgtttgtcctttgcatactcaacaatgctaagtaaatgcacttgcagaacgacgagtagataatctgcatttatctcaaaacacactggcacagaactcttccaccgtcacttcctgtctctcccacctcctttactacccaatgagcaaagaatatgtagctcaaagagataaaagtttaacagttccattctaaagacagtcattcctgttaattgacataaacttacttaaagtgtgttattttgtgaagactacatgtttcaaacgtctactgtataatgatagcattgattaaattgtgtgcatataacaaaggctataatctgaaagtatcttcgaaatatgaatattatagccaagtacacttcaccttctcacttccttcttatcattatcagcccaaaggacaatatcagcgttccaaaagttgttttcagaagatagtcttacctatgaagttttcgggcatacaagaaaagtatataatatgttttagttcatcatctcttcttttgtcaaacattagcaacctctttatcatctagacaacaagatgtaaaattaggacttgcttgttcattgtacagataaccctcaatgggttatgtctcagcaaacccatcgtaagttgaaaatatcctaagttgagagtgcatttttgacttacagtattttcagttgactatgggtttatcttgtcgtaactgattgtaaatcgaagagcattaccaaatgcatattgcttttataccatcataaagtaaaaaaaattgttaaaagtcaaaccagtttaagtcggggaccatgtgtatacactatgtgcacagcaaagtaaaataaaatgcacagaacatgcaggtaatcttgcctaactacaaacacatggtatagaaccctttattccttcctacacttcctttgccttcctcctccctcagtccacaagcacagatctgtaccactcaaagaggaggtctaataatcccatttccgaaagacagtatttcattaaatttattaattccttttatccaggcatttagtggtcatttttagatgacctttaccacatatcttcagatgctttcaccgtccgccataagaatttttactgaaatgaattcttgaaatgtttaaaactttgttacattctttctcgttccacaagtagttatcccttcccagttacctttcttttttaggtctgtggagtcatgatacatctatccccttttcctttgtttttcatgcatttgtcaaatttattattgaatactcctaaattttttctgcctttatcatttgttttttctttttcattgctttagtcagttacccttgcactacagcagtagcctctttattatcttccttgcctttagtcttcttcctttccatcctggaatatttatttcagagcttactgtacaaaaataccagattctatcagagaacatcaaaggaatcacagaatctcagtattgcaaaggatcttagccatctagtgcacacacctgttttttatttgaatctcttctacatttctttttattattattattattattattattattatttttgagatggagtctcactctaatgcccaggctggagtgcagtggtatgatcttggctcaccgcaacctctgcccccctggttcaagagattctcctgcctcagcctcccaagtagctaggattacaggcgtgcaccaccatgcctagctaattttttgtttgtttgattgtttgtttgtttgttttgagatggagtctggctctgtcgcccaggctggagtgcagtggcatgatctcggctcactgcaagctccgcctcccgggttcacgccattctcctgcttcagcctccctagtagctgggactacaggcgcccgccactatgcctggctaattttttgtatttttagtagagacggggtttcactgtattagccaggatggttttgatctcctgaccttgtgatccgcccgccttggcctcccaaagtgttgggattacaggtgtgagccaccgtgcctggccttttgtatttttagtagagacgaggtttcaccatgttgcccaggctggtctcgaactcctgaggtcaggtgatccacccgcctcagcctcccaaagtgttgggattacaggcatgagccaccgtgcctggccttttgtatttttagtagagatgaggtttcaccacgttgcccaggctggtctcgaactcctgaggtcaggtgatccacccgcctcggcctcccaaagtgttgggattacaggcgtgagccaccgtgcctagccttttgtatttttagtagagacgaggtttcaccacgttgcccaggctggtctcgaactcctgacgtcaggcgatgcacccgcttcggcctcccaaagtgctgggattactcatgcctggccctcttctgcatttctgctgagtaacttctgccaggttccttaggctaagcttaagttcctccagtgacaggaatctcactccctcctaaggctacattcctcttttggacaactataggtttaagtttagtcttccttatgttaaggtaagatgtatttgcttgtatcttctcctacaagctctggttcttcccctgaaactacacagaacaagcatgatactacttctttatgaacactctttaggtatgaagaaagctattgtccagacttccctacagattcctcttttctctaagctaattctcctaagcttggttggttttttctagccagtctttttagccctttaccatcctattcacgtttctgtgaactttaacatttatgtatattaatgttaagctgtgaaacctagaatttagtggagtaatgcaaatgtggtctctgttgtaaaatagatcagaactatttattctttatttaaaacactagtcctttaatgtaggccgaaattgtgctaacatttttgacatcgacattctatcttaatgcttatctagtttactaatgaatgaaattcccagtcatctctcacaaaactgtatctcccccagctgtactcaagtacagaaaacatctattcttgataacttttatcttgttagaatagctcttttctcttctatagctacaacttgtcagtgtgtccttatcagcttatgatttaattgaggctatagaacatatacacttaaaaaaaataagctaagaactcttagaataaaacaacataatgtattgtcagttgtaaccatgaatgatgtttttcaaagtgtgtcctctggcctacattagagttacttagggcgcttgttaaatattcagtttcactccagacttaatgaattcagatttctaggagtgatgtctggaaatctgcattttaacaagctccattggacattggtgcatattaaaggttgacagctgctactctaagtactgaaggattgagcccaaagatatgatcagaattaggtggcattaataaaggaggtgatttctggggacagaagaacatgaactgttagagtaggtagaaattccaggtgtagtaaagaagaaataaattgtctgctagggaagatatttgctaggctgaattaggggcccaatagaacagcacataaaaggagttaaaagctaagggacggaaggaaaaaaaacaaagaaagaaaaaactataaaattctgaaaccagtaaagatacatgctgccatttggcagcaaggcagacctgctatagaagaagcatgatctttgtcatcaagaattcatgaaataccaggcaacaccctatgagggaatgtaaaagggtgggggtgtcagcaaagattagtttggagcattgctacacacatctcatctttagttctaggctatctaatgagaaaatctatattaaatctaagttgactgatttggatatagaccagtcggatggtagacagcttgcacagctgcttggtgctcaggaaataggctgttttcactagcatagcaaaactcagagtgctcttggcattttgaagttggtgggacaacagcaagtctctaccagacagaatagtgccacgaaaatggatggtcaaagtcctgactgcccagatggtatcaggagtagtggtcttggtcttaagtatttccatttcttaaagatttcataagtgcacagataaacaagtgtagatgacaacctattttagatgttgattgagagtcttaaggccaggcgtggtggctcacacctgtaatcccagcactttggaggtcgaggaggctgatcacttgagcccaggagtttgagaccagcctgggcaacatggtgaaaccccatctctacaaaagaatacaaaatcagccaggcatggtggcatgcacctgtgatcccagctactcgggaggctgaggcggcaggatggcttgagcctgggaaatggagattgcagtgagctgagatagtgccactgccctccaaagcctgggcaacagagtgagaccctgtctcaaaaaaaaaaaaggtttttgaaacaaaaggccctcctatataatgagtcaatgaaagttatgctcttagagtaaataattatattgtactactgaaatggtaagtcaagtagaactaagaaaatactcatgactctagttccaatttacaattttcaacagaaccataagagaagttgtaattatggaaacttaaatgatcaaatattaatttgtgtccaggcgcagtggttcacacctgtaatcccagcactttgggaggctgaaatgggtggatcacctaaggtcaggagttcaagactagcctggccaacatggtgaaactccatctctactaaaaatacaaaaattagctgggcatggtggcacctgtaatcccagctactcaggaggctgaggcaggagaattgctagaacctgggagacggaggttgcagtgagccgagattgtgccactgcactccagcctgagcaagactctgtctgaaaaaaatataataataataattatgattatatttaaaagatcaaatattaatttgtgattatattttctacaagggcatgcactatttaaaattgagcactcaaatctggtttgcacaactgcacagagaagcttgcaagactgccgaatatgtcctgacttgctactagtcttttgatagcctccttctttggcaaacatggctagtctgcatttgtactggaagccacttgggattcctctttaaacatcagtcattgttcaaaacccacttcgcacttctttctctctttatagatcatgttgcccccaaaatgaactgaacactcttatcttaatgctaatttgacagagaccacttctaatttattatcatcctgcttactcttatataaaattagtgtttgctatagttttttctccctttgaatacctcaaagttgactgacagtttttcctcaacgcagcttgcctctgataacatccagaaaaaatgaagaaaatatactgctttgtaaaatagaagagcttaacaagtacaaatttgtcacttttttcgggtgtttcgaaagagtgtaaacagtaaacattgctgtttatttcttgtgtttcagaagtaaggctatgtatttttatcgagctatttacaatttacatataagatgtaagtattttcatgaatcattttcatcagtggggtggatatacctatcatagcggatacggtcctattctgacttttagatcagaaatcactttcagttatttgtagcacacaccttaaagcctattaaagttctccccaccaaaatttgtattattataatcactggatgtcaacacctgtggctcaaacagtatccaaattttgtatattgttggaggattgctgatttaactgagagttgtagctagaaataaggtgagaaagaatatacaggtaatactaatccacctcaaactaagaagcaaaggatggtggatgggctatgttgatctagcgttgcaaaaacacttttggatgaagtgcccagaaatagccccagttcctttcactagaatcagctcgtcccaggtgaatgccggcagagcagggtgtgtgctccccaagaaagggcagtgaccgctttccaatgtctggcagttaggggcgatgagagtagttgcaattggcaagataaaggggaactttggaaaataaatatacttatgatagaggaggcaggagaaaaggtcaagggctgtacacatgtggaactgataatcatggtagcttggcttctatgaatgggtacatgttgacccttaagtgagcttagaaagcttgagaaatcagtatgcgtgaactgtttgaggcataagaaaggcaggattttaaaactttttttttaatttgtgcaaatttatgggatacatgagaaattttttacatgtatgtaatatgtagtgatcaagtcatggtattcaagggatctgtcaccccagtacaatatattcttattaagtatagtcatcctaccctgctatcaaacattgaatttattcctcctatcttactgtacgtttgtacctttagcctacttctccttagcctcccttcatccccagtcaccctccccagtctctgttgtctacttttccactctctacctccatgtgttcaaattttttacctcctacatatacgtgagaacatctgatttttgtatttttgtgtttggcttatttcatgtaagataatgatctccacttccatccatgtagctgcaaatgacataatttcattgtttttatggatgaattgtattccattgtgtagaagcaggcagaattgactctgatagtagtctagctggaagagaggctatagctacaaagaatcttgacttaccaaaacactagtaacatgtctgtgaaactgctgtagtctaactcatttactactatgttaatttggagcgtgaagttcatcagtggaatgggtactataatttgcaaagttcaagtgacaattctggtagataaagttttaaggagcagatggtcacaactgtcagtctcagaagtaatttggtaagtaaaatagtcatttatttggaagttttttggtaacctaattgtgatctaattgtcaccagttgggagtctaattccattttcatcactcatctgcagaaaggtgagagaaataagctattaattaatagccaatatttacgagctcttactatccaccataaagtatgctaagtgctttatgtgcattatacttaattatagtaactttctgaggtagttactattattatttccagctagttagtggaagaaccaggatttgaatccaggcaaactgactgcagagccctcacttttaacactacacataaaactgagtttatttaacagaaaacactgtcctttaacctgagattgtgtctacctttcaatactaaaatgtactttttatatgaaatggtggtgatagacgatgtcaggtttgattttcttttttttttttttttaagaaatctttaccttgcaaaactaaaactaaaacaacccaatgacagcactgctctccagtttaaagaaaacaaatgttcttttgctagttgtgaaatctaaatttgagaaccactgactagaaaagtgggactcttagtaatttttaaagttctttagagatttttcacctgatttattttctgatttcaacctccttgttttcattaaccttttccttaagtccacctcagccactcattcttcgattatacacaagactttgtttgccattaccagcaaccacaccactttggggatctcagatgtaagcatcttgctctcgcgctgcctcccatttttccttgcttactcctagcatttctcctgttaccaactccagcaacttggaccccactggaacctccagtataatttattctatcagttcccaatctttttgttctctctctcctctttccccagcttaacctccatggtctatcacatatatcctctttgtatacacctttagcagccttgctcctcatcttctgttgtcaaatccacaagtgtttctcagctacctgcctactctgtgccagtattctcgctgttaagcatggcttaagaaaaacacaaaaccacagtgtctgatctcactttaaatttatgaaccaaatctcaagtgagccctcagtatttcttggaacagatattcctagtattccttctgtatttccctagtccaatccatttattctcctattctctgagatgactagttcttcttctctatttggctcaacccccaagcaccacctcttccatctttaccagcagctgatgacctggaatctttacttcacggaggaaatagaggcaaacagaagagaacttcttcatcttcttcatcttcccaccacaagatgtatgattggttgaatgagagaaagactgtgatgtcctagaacttcagttgctcctatatccaatgtaattagcaacttaaattccaaaaccatatataaaaatcgatttttggccatttgagattatactctttactaccactttcctttctcttattataaccaagagttgttactatgtttgtgcctcatccaaataaaaagtaggtattttttagaaaatgattaacgggagcaattagtaaaacaagcagtaaaatacccggatacaggaaattgagccaggcttgctggtatgtgcttgtcccagctactcgggaggctgagttggaaggatcgcttgagcccaggagttccaggttatagtgagctgtgtcacaccactgaactctggcctgagtgacagagtgaaaccctgtctctaaaaaagtacttgacataggatattgagagaagaaatgctttggaactatgtttgattatacccttagcccaccttagttcttacttaagtaagttatagatgaaggagaaaagatgggaatcactttgaagattaaggcctcaaactttgtggaaaatggaggaaaaaatgttgaaaacagtcatgtgatagtttttaccttacacttttgatgggaaaattagataatagaattgagctatacgtatgttgactgcacattacattaatttaatcctgttatttacctcatattgctaacctttaaaattaagatttgaaaaaaaagagatgggtaaaaccaaaaaggtcaaaatttgtatgccagcttagatgaaatttgtatttatagaactgaataagaatctacaccttacctaatactgtgaattgcttatgtaaatacaacaaaggatggtccctcgatgacctgaatctcatatgctgagttcacttagtaacagcgtccgtctgctcagacacattttcccaactccccatgtgctttccaaacctttaccatgtttcccagtatcctctcttcatccctcattttgttgatgacctagttcctgcttcacatagtcaacagaacccaacaggaataacctcagctttcttcctccttgtccctttatttaactggtctcagaaggagaggtgtctttacaagctctccctctccattcctcctctgttgccaaagtttctgaaagtgtggtctccatatctgcttatgctacttagttttcttctaagtgaaaggtagggactcaaccccaaatgctctgaccctgttcgaagaccctgtggcctagagcggcatgtatttcctgatttctaaacctagtgccctttttccaggcctcatcctctatcactgcagcatttatctctgttgtcacattcttctgcttaaaacttttcacagcttttcacgtacccagggcaggcattcaaaaatattgaagcagtagttttgatgtcttttctgagctttcaccagtatttttaataggcactactgcctaaatgtcaaatgccttatagccaaaaacaagtaatgatttcctgtaatctccaaactgattcctcttcctcttgctatgtcttggtatccctgaggttaccatcattttatccatgtacccatgctagatgcctcaaggtcatccttgactcctcttccttctctggtttccatttggtttctaagctttgatgagtatctcccgcatcttcttttctttttctactatttcctatgactcttgcctctttctgtttattgtcttttgtctggattatttcagtaatatgttcaggagtttctaatttggattccatggatggacctcaaaggattaaagaactctctcaaatttgtatgcaaattttttgtgcatgtgcattttcctggggaggtccattagactgttctgtgggaaagagaggaatagaatgagagacaatgacaatttaaatcaggtccactgatttctcgttctatacctggcctttgttatttaggtcactaacctaaggcacttatctctgaggagtgaggtggcatgtaagatattaagaataaaacagcagcattagtcagtccagctgggcagtcagtccagcagccagagatcagaggctcctcaatatcagatccaggctttaatatcctagagaagctcaggagaaagctggggcatcagcaggagcagagggtgtcctcccgaggcccctggacccatttgttcctgtgcttccaaaggacttagagggatatgaaaacttaactggcaagaatccagagtgagttggtatccccagaaaaaggttcagaacattcccccagctagcctcccctcctttgcctgtttggtctctcgttctttctccactctgccaacacagttagcttttaaatacatatctcctggtgtgccttccgtgattgtcacttacacctaagggtgattagactaatcacccaaaaatgtggggttttaatcacctatgaaacaagttaaaaaatcatggtcatggtttcaaggcctgccagttaggagcctgccagcctcgtcgccaggcactgccctctcctcacttccagggctctggctacagcaggttactactggctgtttcgagagaacagtgtctgtgtccatatccctatgcctttgatcatgctagtctctctctttggggtggcatttcctctccattgcctgtgaacctcctactcattcttccaggcccacaatggatgttagctcttcacctgagtccattcttaattttctgccatcactctggcagaatcagtatctcttggctagagtccaaaaacatttcatacatatctctgataatgtcatattatattgtagatagcctatttttatttctgtctttcctactaagccagaaatgccctacagctagggactgtctttttcatgtttgtatccctaacagctacctttgcatctagtctaaacatgagcttagtacacttttgttgaatggaattagttataaagagtttttatgactcatttaaaattagagaccaatgcttacttaataagtcagaataggctgtaataataatagtaataataaagtcccatttccactgcttattcaagtaacagcttcctttgtggaagtacattttgaaagacttcacatgtcagtgtatatttttgatgtgctcatttgagatcctaaaagaattatagttctaaagcagactagagcttctattacattcctgttgaagttatattaaatatattctatcgtttcacatatctgtattatatataataagttgcatgggtaaacattttatctcttttaaacttcatggtaataatttgtgaattgtttattttataatatctgagtaaatttagttcaaaacacattaatttgagcattttctgtgtacagaagcatagttgcaaagttaagattcttgtgtttatgttgttttgttaaattcggaaagtctcagtcttgcaaatgtattttttttttaagtatttaaattagctcagctatgagaataagcacggtccataaattaagagcttcaaataattttttaaaatccttcatattctttgagttttgtaggaaaagaatcaacagtttacttattcagcctttcctgaagtccatagtaggtgctgggcatcatgctgggtgaatgagatagtacttgcatttgaatagtttacagtcttatagcgaagaagccatgtaaacagagaattgcaatataaaccttggaggagaggaaggaagactactttgagaaccgagattaggttgagaatggatgagtctgctgatcaatttatagataaagaagcagagaggtgaagtctttttttttttttttttttgatatgtgaaataggaacctaggttatctctaagaattcatagcagggggtagctcttgagaagaacagtgaagatctggataattaataaggagaattagagatgagctaacaaagacaagtaaagagtggcatgagaaagcagtgagcatagaactgaaactggatagcatgaaattctggaggtatcagtcagtagcacagtggtataattttctccagctgtgctatggagaaattatacacattgtggccaatgtgtagtgaataaagccatattgtattcagggactatggggtggttataacagaaatttacaaagaataaatagttaaaagtccttcaaagaaagcatggcttactagggaaggcagtatggttaagaggaagttgataaacttggagaaaatgtagaagtcaagaagttggagatcagaagggctggtgctttgtaggaactcagaaaatcttcattttcttctttctggatgtcctctccctatgaatgtttcaccaccacaacctgcctcagctacagtttatacatatgaatagtttcaaatcatgatggtaacagttggctcagagggcaagattaggagccagacttcaacgtgctgctaatccagcgtgtccctgtaacttagatgctggtagtgcttggtggtattggcctctaggagaagctcaaggcttctcctgttatctccctaccactcatacttggagggtgagtcaaaggccaaaaagcattttattgggcagtggttcttagggaagggatttactctgtgatgcagagggttaagactgtaagccatcaagtgtttcccctccctctccatgttcaaccaaaggcacagttcttattactttcaaggatttaaaaaggagtcttttctcagcataaaggaggaagtgaagaccaattttgacagcccaaagggtcttcctcctcagaatctaaaatttctaatagagttgtttgcatcttgtgattttacttgagtcatcaaatgtattgtactttttttcttaaagatatacttcttaatgctttcatttcagataaggacaaaccattttccatggcgacacactatttatattgcattttcagaaatttccctttttacccatacttaggagtgtgacactgaaacctgataatctattatttcacagagtgcttttttgggtgtaatataaagatattatataattttaataacctttgaggtacaagtggtttttggttacatggatgaattatatagtagtgaagtctgagattttagtgcaggacccattgtccaagtagtgtaaactgtacccaatattagttttttattcctcactcccctctcactttccccacttcttaattttctgccatcacaatgtgttgcccaggctggtttcatgccctcactttccccacttctgagtttccaaagtctattactctgtacacctttgtgtacccataacttacctccctcttgtaagtgaaaacatatggtatttgattttccattcttgagttacttcacttagaaaaatggcctccagctccatccatgttgtagcaaaagatgtgacttcgttctttgttatggctgaatagtattccatggggtgtgtgtgtgtgtgtgtgtgtgtgtgtgtgtgtgtgtgtatacacatatatgatatataataattatatataatttatcgttatatgtaaaacaaagcaaattttttatttttatagagacagggtcacaaagtattgcccaggctggtttcatgctcctgggctcaagtgagccaccacacccagccaaaaataagtaatatttcccagttagacattttcagagtaaaaagtatttgttcaaaatcatagcatgaatggactcttccagagacctttaactggcagcatttccccctcaaactttagtacagttataggaattgtttctggatttttggctgtatattcttgttcatggctcatggacattaacatatgtgaatggcatcactgtgtttttcctaaagtgcatacgaagaagaaagaacactttcctttagagtcttacttagattctagttagctgatataagactgttttcttttccttttcaggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggagggtaatgtgaacataagtgtgatttagtaaaagtttatcactcgctatacgatgaatgagacccagagttatggagacaaacttgttgctttgatttatattttgaagcaacttacaggtaaatttacctagtacctaggttatatatggcactgcaccagggactgtggaagatttacgtgatgagcagatgttgttgcccacatattcctataaacaaaggtaggtgattgtgtaagccagaggttttgcaaaaataggtcatgaatatattttcaggtgacacttttattccatattgcttccagagacttgtgctcatttatcctttggaagaaaaggggaaattaaatccataaatagacttatgaaatcgtattatgtaaggttcatatgcaaaaagctatcttacttaacactgagtcttgctcagttatagagtgacaggattgagttgtcagagctcaaaggaaagcttgatttgcgtctcagaaatgaaattatttaaaaatcaagctagaatttactaattctgatagttttacatgtcaacttgactaggacataaagtgcctaaatatttggtaaaacatttcggttgtgtctgtgaggatgtttctggatgaaattagcgtttgagttgatagactgaataaagcagattgccctccctaatgtgggcaggccccattcaatcagtttaaggcctgaacagaacaaaaaggcttactttcctgcaagtaagagggaatttcgacttgcctggttaccctgagttgggacattggtttggatgcacaccgaaacatcagctcttcctggcttggaggcctttgggctggaactaaataatgcgtattagctctcctgggtcaccaggttgctgacagcagatcttgggacttgtcagcctctgaaattgtagatttatcccaaggaattggctaaaacgattatggaggctgacatatatatgtgggtgtatatgcatacatacatattcatagagatttatcataaggaaaacacacacacacacacacacatacacgaacattctattggttctgtttgtctgttctgattaattatcctaatactaacatatttttttcattgacagtttaagaacaatgccatgagatttctggttctagcaatgcagtagactaggtaaccagaaaaccttccttctataaacaccttcaaatgctaggtatacactgtaccccttaaatatgcacagttatgtgccaattaaacacaaaataaaacttttaaaagttctgggtaaaacataactgaaatcattttaaatgcataattgagctcttcagaaagaaaactggatctccaggaaattagagtcgtgagatacgggctgcagcttttggtttcataatgtatgggtttgggttttagtacccactagggaacagaacatgagtccttgaatccatttacagtgtggactaggaactggtaccttcaaaggggttgtgtctatgaaaagagtggactagaaaatatctgctgccaccacagggaaattaacaaaaaatatttaactgcctgggttctggaatggaagctgggaaatctcctatgggaattcttcttcttttttttttttttttgagatggagttttgctcttgttgcccatggtggagtgcaatggcgtgatctcggctcaccacaacctccgcctcccaggttcaagcaattctcctgcctcagcctccccagtagctgggattacaggcatgcaccaccacgcccagctaattttgtatttttactagagatggagtttctccatgttggtcaggctggtctcgagctcccagcctcaggtgatctgcccgccttggcctcccaaagtgctgagattataggcgtgacccaccatgcccggcctcccatgggaattgtaaaccatggatccttgttcatgctggtttagaatttgaatgaatgtatgctacctatgtggcttgaaacccgaagctgagaaattagttaaaaaaattattcaggtgcagtggctcatgcctgtagtctcagctacttggaaggctgagatggaagggtcactagaacccaggagttctaggctgcagtgagctctcattgtgccattgcactccaacctgggtgacagtgcaagaccctatgttaaggaagaaaaaaattagtcctgggctagtgatagcataagttgtcagatataagcaaaccccagggggtgctccaacaacctaggctgaaaggaatagaaaaagtagtcatgaaaatttaaaactcagcaaccaagtttaagataagacaacaaatttcagctgaagagagaagtggtaaacagaagaataaacctaaagaaatcacccagaatgtagcacagagagataaagggatggagaagatgaaagttgagatgagagagttaaaacaagaagtccagatagaatagtgtagaggcattattcaaaaagagaatgactaagaatattctagaattaataaagacataagtactcagattcaggtagcaccatgagcctatatgggataaatgaaaattaacttatttctagacttgttataggagaatgccaaagaaaaaaaatcttagtaacaaaagaaagacatggagatgacttacaaaggggtatccattatgttgatagcaaacttttccatgacagaaagagagaacaaaaaacagtagaataatatcttcagagagctaagtgaaaataactgtcaacttaaaagttaatacccagcttaattctcattcaggaatgagggtgaaataaagactttttttcttcaggcaaaggataatagaattaactagttgcagaagcttgttggaagattatgaagcaagatgtactgagactgaaggaagttgaacccagaaggaaacagtagagccaagaaacaatgatgagcaatgaaattggtgaaaatatagataaagtctgggagttctacttctagtagtggcaaattaggtcatttgagtcatgtgttccactgaagactaccagaaaagctcaacacaatatttaaacatgttttgcttgaaggtatcaaagaagaaaaatggaggcctagaacaaaggtcctcctggtatactgggtcactgttcctctcgagatattagccagttctgcaggaagctgctaaaacctaagcagcccttttgacaggctagtgggagtaatgggggcagagattagtgcccatggcccctaaggaggggacacctgatgaacataactcattttgagtcaagaccctgaagggctacaccataggagcaagggttaaccaggagtagacatactctcactgaggctgcagatcagctttgaatcatgtcagtccctaaaattagattgagggttcctaaattgctagtgcccctaggcatctggcagaattgtaaatccttcctggaagaaagtggtatcatgtaaggtcacaaattgtttctagtttgcaaatgcaatgtctggcttataatcaaaagcaactggaaacagatacacaaacaacatcaagaagaagaaaagatggttcaaacagcctctagatattggaattctcagatacagacttttgaaataattatacttaccacattcaaggggataaaagacaagacagatttttggcagagaactggaaactaaaaataaacaaatataaattctagaactgagaaaatcagtaagtaaaattaactcaagtgaatgagtttaaatagcaggttagacacatctgaagagagaattagtgtactgaaagatataagatgaaaataaccagagacaaagaatgaaaggaattaagagagagtaagagagagagagagagagagagaataccgtttaaaggtctggtgcgtgtatttaaagttccagaaaggcaagagaaagaggatgaatcaaaatcaggatttgaagagaaaatggtttagaactttctaaaactgatggaaaacattagtccataaattgcagaaatgatatgaaccctgagcaggagaaataccaaagaactctacatatataggcattattgttaaattgctgaaaaccaaaaatgagaaaaatcttaaaaggagctagagagcaaaggaaaattaccttcaaataagcaacaactagctagtagctgtcttctcaatagaaatgatggaaacaaaaagtcaatcaaaggccatttttaaagagctgaaagaaaataactgtcaacttagaattttatatccagtaaatggatgaatgatcatagaaatatataatggaatacaaggcagtaatgaaaataaatagcctacagctatatacagttgtgaatctcacaaataaattattgagcaaaagaaaccagatttcaaaaaacacatactgtgtgattccatttatagagagcttacctaaagtatagtgtttaacaacacatgcttgggtggtaaaactataaaggaaaatgaattattaccataaaaatcagattgtggttacccatggggaaaggtcagggaggagtgcttgggaggggttgtgaggaggtgctcccaggatgctagcagtattctgtttcttatgattacgtaggcgttcattttgtgacagttcattgaggcatatattcacattttgtaacttttctctatgtgtgatgtattttgcaattaaaagttttaaaaataaattttaatagcattcactgagaaaaacaataatgatatgaatatttttaaaggatagaactaaaatatggaaaaaaacgtttgggaagtagattaaattcatgtaagctccttatattattggggaagatggtagggagtttgagaccagcctggtcaacatggtgtaaccccatctctactaaaaaaatacaaaaattagttgggcttggtggcgcacagctgtaatcccagctactcaggaggctgaggcaggagaattgcttgaacccgggaggcggagattgcagtgagccaagatcgtgccactggattccagcctgggtaacaaaagtgaaactccatgtcaaaaaaaaaaaaaagaagctaataatgttagttaacattaagtcaaatgtgcatgtgaaagttgtacattgtgcccaaacttttccaaagcatagggaggagctgggaaagaaacagtggaaattcaaatactttagaaggcaagaaagaaataacaagactcaaagacaatgtgatgataataaaaaggtaattttaaaaacaatttcatttatagcagaaatcagaatgtaaagtgcctaggattcgatctagcaggaaatgtgcaagacctttaaggagaaaattctaaacatttttgaaaatctttttttaagcagctaataaatggtaagatataacatgttcatgtatgggagaactgacaatgtcataaaaatgagttctgcccatcttggtctgtaagttgagtgtatttccagtgaagcctaataggaattttttaacatttgacaacttgattctaattttttttgaggcttgaagagttatgagaattttgaagaataatgaagatttacttttatcacatatcaagacttactagaaagcaatagtaattgaaacaatgttatatattcatgcaaaaacagaccaaggaaacaatagaacacaggaaggaagagcctgctctatgacaagtgatgatacagatcagaggggagtaataggctggctgtgccttaaacggagctgagataattgactacctatttggaaaaagataaaatgcaattcctacctcacagcatacaaaattgcaagtggatttacaaaaaaacaaaaacataaaagcctactaaaatttataggaggaaaacttatttagaagaaaaataggcaaaaatgttttaagatttgaggctagggaagaattgatacagaaagtaaatccattggaagtgttaatttggctacattaatataaagaaaattctgtatgacaaattacactgaatacaaatgtctcaaactgggagaagatatttgcagtgtatataatctacaaagaattggcatcctctataataaattctctataaaaagtcttgtataataagaaaaatataaataccacaatttaaaaaaactgtcgaaggatttaacacgtagttctcagagaaagaacacaattgaagaaaagcaaatgaaaagatattcaggaaaatgtataataaaagagggattatttcttaaacaacctggcaaaatttacaacagctggtaaaaccaagagtttgtggggttatggagaaacaaggtctcatatacattgctagttggagtataaactagaagaatataccaagtgggtagtatcttgcaaataaatttgacatcttacaaaaatgaaaatgcacaaaccccatgagttctacttcaagaccactacctatgataaacaacatgacatgtaccaggatgttgattgtcatgctatttgtaatagaggaaaaagaaacatcattactcttccttagtaggaaatggaatagcatacagatattaaaatgaatatgctgagcacagtggcccacgcctgtaatcccagcacttcaggatgccaaggcagaggatcatttgagcccaggagttgaagaccatcatgggcaacatagtgagaccccacctctacaaaaattaaaaattagccaggcatggtggcacattcctgtggtcccagccacttaggaggctgaggtgggatggtcacttgtgccggggaggtcaaggctgcagtgagctgtgatagtgccactgcactcccgcttgggcaacagaatgagaccctatctcaaaaaaataaaatgaataatagatttacatagatcgacatgaataacactcagaaatataacatctcgtcttcaaaaaaaaaaacctagtaagctgtactgaattaatctatcctaccatttaaaatttttgttgagggtaaaataatattaaatattccctttatagcaatcctcttagtgctttaagtctgcttgttgggtccttaattgtttcaattttatacaaggtcgtttcctttcctgctttccagcatttcattaagttcttgttcaggtctccagctagatcagtctcattggttctagcaggtgtgggtcttggtgggttggtgcaagtccattcactatttcaactcttcagaaagtcccggaaccagtcagttttgcagttcattcctaatactaagattgtttctgcttcacttatctttttaacttacctcagtgtaccaagaaaaacagtcatcaccatatactatctaggttgaataaactccgcttaaaaattattttagattattttccaaataatttacaaaatacaagaataaagagataaaaaactattaaaaattaaataagaacttaaatatataaataaaatttttatgccatgtttccctggtcttgaggtgttttggattttggtttttggaatatttgcatatacattaagatatcttggcgttgggactctggtctaaacatgaaatccatttatgttttgtatataccttgtacacacagcctgaaggtaattctgtacaatattttaaataattttgttactgaaacaaagtctgtgtacattgaaccatcagaaagctaaggcatcactatctcagccactagatgtggatggtctgtggttggttggcatcaccattgtttctgagtgtaaatttatatgcctgataaataatcgttttcatacatgtattgagacacaagtacttaacagtaaaaaatatgacacaccattaatacagtgaaaaaatagtgagtttagggtaactaagcagcacaatggcatcaccagaatacctggataagctgttaaacaacagcaacaccaaacagcaacagtttcagtcaccacctacgatgttgtggggggcttttgttttggtttggttttttgagatggggtctcactccatcgcctaggctggcatgcagtggcaccatcatggctcaccgcagcctcaaactcctgggctcaagccgtcctcctacctcagcctcccgagtagctgggactacaggtgtgcaccaccatacctggctaattttaaaaatctttttgtagagacaaggtctccctaggttgcccaggctggtctcaaactcctgggctcaagcgatcctcctgcctgagcctcccaaagtgctgaaatgacaggtgtgagctaccatgcccagctgatgttgtgttttgattaaaagattatcatacagtaaccccctgtgtgtggtgcacctttcagattttggaacattttggattttgaatttttggattagggatactcaacctgtataccccaaatgggcaggagcctctgaatgcagtaactgttcatcagctgtcctgcatgaacttacaaatactgattctaagtttcaaatacatctttgttggcttctaaattattattacttctggttcttcttgcacttacagcatcaaaacataatgctttaagaatttttttgagatctttggctcctaattttgttgaagagaggatgaccattatatgttccacagttgcaaaacatttttatttttagatttgtagatacctttcagaatgatcaattctgttttttatggtcaatccaattttttaatgtctacttcatctatttcttctggctatctctctgtaatacctgccttcagcatctgtctacttttaaactatatcaagaaaatttggtgcacaaatgaaataaaagatgaaagaatactgtcatgtgtccttttagcaaaatgggatggcctcatttcttgtcacaagatattccacaaagaagactttctattgaataagtaactgaatgaaaatgctttgtccttagattaaaagtatattattcactcattgattcttgagtttgagaaaatgtatgtagggcatcatcatctgaagacacatagactgagattttacttataatcatcaatttcagcatctttattagagtcctaagtgctcctatcttattctttgtgttcaacttctgactcatctaataattctaaaacagtttcctcagattttcttcgtcattctggctagagaacttacaaatgttaatgcttaatcgtattcaataaaatgtagaatgaggtcacaaaagatgttagctccagacttcttttatgccttcttgaaagataacacatatcttgcacaacacagtaagaaaactgaagagtgatgtcatagtgatacttgtttcactgtttctaagtaatttagtcattttttattatactttaagttctgggatacatgtgcagaacttgcaggtttgttacataggtatacacatgccatggtgactggctgcacccatcaacccgtcatctacattaggtatttctcctaatgctatccctcccctagcccccccacccactgacaggccccagtgtatgatgttcccctccctgtgaccatgtgttctcattgttcatttcccacttatgagtgagaacatgtggtgtttggttttctggtcctgtgttggtttgctgagaatgatggtttccagcttcatccatgtccctgccaaggacatgaactcatctgtttttatggctgcatggtattccatgtgccacgttttctttatctagtctatcgttgatgggcatttgggttggttccaagtctttgctattgtgaacagtgcctcaataaacatgtgtgcatgtgtctttatagtcgaatgattgtaatgggattgctgggtcaaatggtatttctggttctggatccttcaggaatcaccacactgttgaaacagcatggtactgttaccaaaacagatacatagaccaaaggaacagaacagaggcctcagaaataatgccacacatctacaaccatctgatctttgacaaacctgacaaaaacaagcaatggggaaaggattccctatttaataaatggtgttgggaaaactggctagccatatgcagaaaattatacaaaaattaactcaagatggtttaaagatttaaatgtaagacctaaaaccgtaaaaatcctaaaaaaaaccgtaggcaatacctttcaggacataggcatgggcaaagacttcattcttctattttcttattttaatcctttttaagcatagttgagaataattgatgagtaatgatgtaatttctagtgtgatgaaatagcataatgtgtcttagattcataaaaagatctagtagatccaaatggcaattgtaagatagaattttattctatttttttaaatattgggttttttgttttgtttgtttgctctttggaaaaaggaaaaaagtcatgagatatcaatttttataaatagtactacttaaaacagaaactcagaaactgagattgggtctaacggaccctaatgagatactgaggattaaacactaggcagaagtgagttaaaatgccatatggagaagcattttataacatctcagttgtgatagttaaccacatggctgcataggtaactttggtgctgtttttaaagttgcaagcaatttaaatattaaactactgatgataaaattgagttagcaaagaatttccagttcgatattaattatagccagccttttcagttatacctttctcacatccagaaatggcttgatgtactcagctaatgacctcatgcaggatatatatgtgtgttacataataaagaaaaacatcacttctgtaattttggacagtccacactgacggagatgaacacttgcatataggtcaaactagttaaatatagaacagccgcttttgaaagctgttgccagggctcaacagcgtcagctctgtttctatggagaaagactttgcagatgttaaaaacagagctagaagccaatgaatggaagaggattgtgctgtggaaatttaatttttttgataaagggtttattgatgaatcagctatattagtctgtgaacgttaatcttgacatcttctttacccaattcccaatttcttggaataagatcttgcttttatttaagtaacacacaatgtaaaatttgatgttattgtactgactaggtggggtaagggacctgatgacaggtaacaagattagtaaggttctgaaaaggtcagaattgtactgaattatgtttagaacagattgcctccgtgatcatttaatcaaacagtgttcgtattgtctttgtccttgtccacatacgtgatttttgaggttgggctgagaaggaaatcatgattccatcaacaacataaggcacattgacagtaaaactcatatattatagcagctttttgtttcatgctgtatagggcagacaaccttgaagaaaaaaaaaactttaaaaaataatgtaaaatttcacagtttttcagtcacaaacagaagtatccttgttgtcactgaagatgacaagaattaatatcctgctgtatagaagtactttggcaaagttaaggttgtagttccaattcctcatttccaattttttctccagatggaaagatgaacagtttttggtattgaatttttttttaggaagcaagttatttatcattagatatctattcagtaaatgcaatgatacagaaaaatgaagtttttttccctcagatttgaaattaggttttaaaatatggagggagaacaatttgtaagtaatgttcaggaacaaaaataaaacctaatgaaactttagaaactttgatggacatctgtcatcctacatacaattgcattaaagaatagaatttattattattttatctggtttattatgctgtaaaatgaatttttctctttttgtatgtagttttatgaaatttcatacatgtatagattcatggaaccactgtaaaaatcaggatgtagaacatttgcatcacccccaaaaactccttcatgcagtcccttactggtcaccctttctttttagtaaccctggtaactaccaatgtgttctccatccctgtagttttatcttttcaagaatgtcatataaatggcgtcatacactatgtaacctttggggactggctgtcttcagcataatgcctttgagattcatccaagttgttgcatgtgtcaaacatccctttttattgttgaatagtatttaattgtgtgggtgtactatcatttgtttatctcttgacccactgaaggccaattgggttgttttctagtttggggcaattatgagcagagctgctataaaccaagtagtggaatttttaggtcatatagcattttatctattttttatttaaaaatatatattcagggtttgtttttgacccagttgaatttccttcaggtcatttttggaactctttcttcctatgtctgatgtaacatttcatctttcatctttgtcatttttttattcccccttttcttcagattactataggtatattctggtattgtagcccagaatctgtcctgcttttatattcctccagcttaattatatgatccatcttcttacggtatctacggcttgctacaagactattctttactatttgcagaagacgttcagatgtatcttgctatccttttttattcagttgtgtatatcttgttctctatttggaggcctttccaaatagatgtcttgttaactctttaatcttatcatgctagaaacaaacaaacaaacaaaaaaaattcccttgtatcttttcccttctgcagcttccttatcatactacagggtaatttcttttcttcactgtcagtcttccaccctacatgcaagcaataatcaaatctagcatttgctgtttggtcatcaccactcctgtcaccaaaattctcattctgtttagattctgcttgcctcatttatgtaccattatttgtttctcactgaccttccaagtgcatactccttttcatcctaaagccaagaataaaatcattttatataaagagcattctactttgcagttcatttactgatgtcctctgtttcagtaggaaggcctaattctagatttcagtctgtcatgatagtactataacttctgcttctcacattaggtaaattttattatcccttttataggaccttgactgcctctgggccttctgttcagttgaacccacatgcttctaacttcttagctattagaccctctctttccccttttatatgtctttgttttggtacagcttctcatacccaaaagcaggtatacctgttagtaaggaggatacaagttgtatttgtaggtggtatgattgtctacctaggaaattcaaaagagtcagatttttttaaaaacttagatattataaataagagtaaagtagccatatataaaataaatacataaaaatatatttccttcatacttctatactgtttctgaaatataatagaaaaatcccatcacaattgccaccaaaaaacatagctaggaatctttatgaaggaatgaaggaatttaaacaacaaaaactataaaactttattgggaagctgggcccaatggctcacgcctgtaatcctagcactttgggaagccaaggtgggaggatcacttaagtctaggagttcaagaccagcctgggcaacatagtgagaccttatctctaaaaataaaaataaaaataaattttaaaactttactgagagacgtaaaagtgttgaataattggagaggcattattcttctaaaaaaccaaatatgctatacagattttagtatttcctaaacttagatatttaacctaatttcagtcagagcttgggtttttgtctgttctttatttttttatttttaattggtggaggttattccccctcataagaatgattctgatgttcatttggaaatacacatggttggaaatagccaagatagttatgaaaaagaagaatgtatagaggagaagagcttcttcaatgtactactgtaaagttatggagataaaaacatgaatgaatccattgagcagagtagacaggctggtaataacctagcatacatcaaagtccaaaccttggtatgatggcagctcagtcaacgaagaaaggagggataatttagggaacaatgctgggtcggttatttgaagaagaattagttggcttctcactttacttgtaccatacacaaaaataaaacaccagataaagaattatatgtaaagcaaaaatttaagaaaagaaaatatgtgaccatcagtgtctgtaatggggaacaattttaaggataaaactaatgaaaatatcataaaaataaaaattgtgctggctgtttagtagaaacagaaaacgccttccacttaccgaaaatataccataaataggctgggcacagtggctctcgcctgtaatctcagcactttgggaggccgaggtgggcaaatacctgaggtctggagtttgagaccagcctggccaacgtggtgaaaccctgtctctactaaaaatacaaaattagccagacttgatggtgcacgtctgtaatcccagatgtgagaggctgaggcacgagaatcgcttgaacctgggaggcggaggttgcatgagcagagatcataccactgcactccagcctgaacgacagagcgaaagtccatctcaaaaaaatatatatacttatatatatgcacacatgccataaagaaaagacaactggcaaactagaataaagtagttacaagtataataatggccctaatgtataaatcattttttaatcaataggaaaagctcttgaatttcaacagaaaagggtatagaagacatatcaaatactaataaaattaccaatggtaaaaacatgattttttaacagcaccagccccttcagtaattagataaatgtgatttaaaaacaacagaaagatactattgtccatctatcaaattgagaattacttttaaagtgtttctaatattcattacttgtgggaatataccaagataggcactatcaggtactgtgctgggattatagattgataaaacctttctggaaaagtgtttctactttttcaagtgttcctatttcaagggccttaaaatacttaacacaccttttaacctaacaatttgcctttagcaagtattcatctatattgtcaagcgtttaagtataaaagtgttcattgtaggctgggtacagtggctcacatttgtaatcgcagcactttgggaggttgaggcaggaggatcacttgagtcctggagttcaagaccagcctgagcaacatggcaaaaccccatctctacaaaaaaaaataaaatattttccaggcgtggtagcacgcatctgtagtcccagccactcgggaggctgaggtgggggattgcttgagcccaggagtttgaggctgcagtgagctttgatcgcaccactgcactccagcctgggcaacagagtgagatcctgtctctacaaagaatgaaaaaagaaaatgtttattgcagcaacatatataatactaaaaacttagaaataattaaatatctaacagtaaggaatgaatatggagtaggagagttaaactgtgaaaccattcatatgattaaatattatagagctattaaaaatcatatcatcggccaggcgcggtggctcactcctgtaatcccagcactttgggagggcaaggcaggcggatcacaaggtcaggagatcgagaccatcctggctaacacggtgaaacccatctctactaaaaaaaaaatacaaaaaaaaaattagccgggcatggtggtgggcgcctgtagtcccagctactcgggagtctgaggcaggagaatggcgtgaacccgggaggcggagcttgcagtgagccaagatcacgccactgcactccagcctgggcaacagagtgagactccgtctcaaaaaaaaaaaaaaaatatatatatatatatatattgtatagggatgggaaagggtttaaaataatacctgtactgaaaaacaggatgcaaggtattacatagctccattttggctgagtttgagatgattgtgatttctttattttttgctattttcccacattttttataattatatattttgcaattggaagcaaaaataaccattgaaaatcgttttcaaagaataatattcaagagaatacaaggtgcagtaagttcttaatatttagttaaaatatagaaatctgtggaccattaacagcacttatctttaggtaatgtaatgatgttttatagatgggtctttattgatgggatgtcactatgttgcccaggctggtcttgaactcctggcctgaagcagtcttcccacctctgctttccaagtagctgggattacaggcacaagccatggcaaatgtagtatattttaatttatgtttttagtgatggaatctcactgtgttgcccaggctggactccagctcctgggctcaaggattcctccagcctcagcctccagagtagctgggactataggcacgtaccactctgcccagctttatttttacactttatttgttttacaacttttgctctgttaacaaatctactactcctttaaaaagttaaaaaacattctcttattaaaacaaagattaggctgggcatggtggctcacgcctgtaatcccagcactttgggaggctgcgctgagtgaatcacctgaggtcaggagttcgagaccagcctggcaaacatggtgaaaccccgtctctactaaaaatacaaaaattagccaggagtggtagcacatgcctacaatcccagctactcaggaagctgagacaggagaatcacttgaacccgggaggcagaggttgcagtgagctaagattgcgtcattgcactccagcctgggcagcagagcaagacttcatctcaaacaaacaaacaaacaaaacaacgattatatccttatcagagatttaatggatactaaccatatttaatcctcagtctcattatgctcatttaatttttattatccgtatgttgtcatatttaggttatgttcattttttaccagttttgttaatccctagtattttttgtttttgagacggagtctcactctgtcgcccaggctggagtgcagtggtgcagtctcggctcactgcaacctctgcctcctgggttcaggtgattttcctgcctcagcctccagagtagctgggattacaggcacctgccaccacacccagctaatttttgtatttttagtagagatagggtttcaccatgttggccaggctggtctcgaactcctgacctaagttgatccatcctcctctgcctcccaaagtgctgggattacaggcaggagccaccgcacccggccgtgttttttgtttataaaagaaaaaatttccagagtgcactttactccctgataggagactaaattacttaaatataaattttagaaggtacgtgttaaattaacctaatgaattagtagcattcagaagtgtttgtatctgttaaagattcaaaatatacaaactaatttcttttaatggtgattctatttctagtaaactaaggcagaaatcattatgcagaagaaacagcaccctgttaaccatgttctttttataaaccgtctctgttctcactttattgttaggaaggcgtaatctgttttcatgtaatataagtacatgtgagtcatgttgagtttcttcactcatttgtccaattcccagtcaacctgtaggtggagttaacctttagttacataatataacgaaacaaacattaaacctactgcttctgggacagtcttctcaccaaaactcagggaaaatgggagggtgttgccactgactgacttaatgaaagtatctgacaaatgtaaggtctttcaaatagtgagataagaaatgtatataaattatttgatcgactacttactttctatctatacacacacactatcagtatataatgtgtattttcattttatagctattaaatatgaggttctagaatgagttttcagtttgcagaattctgagaatctagttccaacacctttgagaggacaacaaccacaattgcacttgccatatttattagtcaaaatgaagcgaagtcaatctgttgaaagctttgttttgtttttctgattagtttgtttaataagacattcaaattatgatctttaatataatttcttcccctaatagcttggtgctaacagtggtttgcacatcatcatctttgatgaaattgatgccatctgcaagcagagagggagcatggctggtagcacgggagttcatgacactgttgtcaaccagttgctgtccaaaattgatggcgtggagcagctaaacaacatcctagtcattggtatgtttactttttaaaaaagtactattcattcaaaaacgttagccataagttctgaattaagatgtgtgtaggttgtgattaaactgttttgccagtgtttccaaattagaatccagtgatattgaagaatctattgtaatgcctaggcttaataggaaaaataaaagatggatttcagtcacttgtaggtttaagcttatagctcacccacaggtgaaaaagatgtaggttgaagcttatagctcacccaaaaatgaaaaatacacatgaaacaatggaatgcagtggttttcaaactgggtcttgcaggccttcgggggtcctcagaggtgctttcagggtcagtgagggccagggagtgcgtttcagatcctacatcactattataacttcctcttttagctgttttatgtactgaggtgcttctgaagatgacttctgggggaaaaaaaaaaaaaacaccctgctgttttatgaagtctgaaaaccactggcctgtaaaaaagagaaggaactttggagtcagagagatcgtgtcacattgcccctctgtcactttgacagattatttaccctttgaatcttaaattttctttttaaatactggaagttttcataacatttatattccattggcttatacagtagtgaaatagtaaagcaaagtctccttagcttgttagggaaattactattcttacatatactaaaaggacatttgattttatttttgaactctgatcatttgttgttttgttttaacatctgtgttcaggaatgaccaatagaccagatctgatagatgaggctcttcttagacctggaagactggaagttaaaatggagataggtaaggagatctgtcactgattgggtgtgtggtggggggagtggaggcatttagagttcattaacaggaacaatgtcatatggtgtagtattttttagaaaaggtttatatcatgagaagtagatgtttacatgcttgagtacctataaggaaaacattaggatcataataatctcctctaggctgggcgcagtggctcacacctgtaatcccagcactttgggaggctgaggcaggtggatcacttgaggccagttgttcgagaccagcctggccaagatggtgaaaccccttctctactaaaaatacaaaaaacttagccgagtgtggtggtgtgcacctgtaattccagctactcggaaggctgagataggagaatcgcctgaatccaggaggcagaggttgcagtgagctgagatcgtaccactgcactccagcctgggaaacagagcgagactctgtctcaaaataatagtaataataataatgataatctcctctgatggtgctttcgagactaggaaaatgcctattttatttttaatttcatcaggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggtcaggaaaatcagctaaacagattataaacattatgccagtattctttctctttcctttcaagcatatcaaggggtagggaaatgctgacttttggtggagaagagatggtaaaaggaataagaattaattgtcaactgctaaatcttcagagtagcaggaaggaagataatgtttgcatctgccctgtagtaaccactgactcatctaccttaggtcatcaccatctgacacagacacgtaaagtgaaaattttgaagaagtgtttttaaatctttgtattgtattaaaagttgtaatatggccaggcatggtggctcatgcctgtaatcccagcactttgggaggctgaggcgggcggatcacaaggtcaggagatcgagaccatcctggctaacacggtgaaaccccgtctccactaaaaatacaaaaaattagccgggcatggtggcgggcacctgtagtcccggctactcgggaggctgaggcaagagaatggtgtgaacccaggaggcagagcttgaagtgagctgagattgcgccactgcactccagcctgggtgacagagcgagattccgtctccaaaaaaaaaaaaaaagttgtaatatgtcagaggaagtgggagtttccacgtactagaattttgggggctgctttattcagcaaatatattgaatagttgatgtgttcaagctattgggctggagacataaagataattgtgaactcttccctcaaggagttcagagtcaggaaaatggacatattttcaaattagtacaataatattgtagttaccatggtagaaatacgtactaggatacttttattttgataaagtgctcttgatcttccatctcttctctcctttaggttttagttaccacctgtagacagatttactgaacatatctgtctcctactttcagatttgtactaaataccctcacctagatgttttatcaggtctcagatttaatattgcaaaaccaaatttattgtcttttttactactttcctttctgctcgcatttccctgtttatcccaatttcccaggcttaaaacatcaggattatctttgattcctggcactctactgtgccctaggtcaagtcacttgccaaattttttcagttctgtcttggcagtgccttttagttctcactgccactacccaccttctctttgattaaccttcctgtatcatatcattcaaccattcagacactttcagtgattccccatcatttacaaaacaaagtacaggcttcttttgggtcttttgggtcctctagatctgaccctaactggcctttccaaatgtgctcctgattattctccacatacttcagccaaacttaaataatcaccggtcatcagacattaatttatttttcaacatctctgctttggttttgttttttttgcatcactgaggatcttcatcctctacgtttacctgtcttttcaaaacctggctcatatgctaccactgtcctcacaccttttcacattttccctttcaagaatgttatacccgtttccttcttgaaatagtaatgtatcatttatggtactgtcagttgactttggttcacagtagatttattcggcatctactgcatgctagaccctgtgctaggagttaataccccgactgcaaagaagtaaagtacctaccattaagctgccctcagtctaaccctccacgtgcagtaacagaaagtacatgcaaggcaagagagtgaactcgtgtcagatatggtcaacttgtggggtgagagaaaccttcatatgcatgtctgttggtagagcagggccttttaggtagagggaacaacatatgcaaagaagcagagacacagaatagcatagtgcgttggagtagtttagtattgcttcagcatggaagttaggggagggatggtagagagattgtgggggataagtcaggagactaaagtagggatggagcacaaagagccttttatactctgctaagaagtatggactttttttctgtgagtagtgctaagccattgagttttaagaatagcagtgacatagtgttaaaacataagatcactctggcagctctgtcgagtggagtagttagaggagtggagttggcgacacaggacaagagggggagcttttataacagttcaggcaagaaataaaagcctgaacagttaggttgagtatgtagatatttgggtatatcctatcactggttctagaccaggaatccagccaactaccagtttttataaataaagggcttttttggaacagtacacattaatttgtgtactgtctatggctgcctgcatgctacagtggcagagttgagtatttgcaataggggctgcatggcccacaaagcctattttagtgcttttattttaggtactatctgccactttacagaagtttgctggcccttgttctagactttaaatccttatcttattcacctcagagtctcccatagtaccccagatagatctaaataatgagcacatggtaggtgtccagtaaattatttttctttttttttttttgaaacagagtcttactctgtcgcccaggctggagtgcagtggcacagtcttcgctcactgcaacctctgcctcctgggttcaagtgattctcctgcctcagcctcccaagtagctgggactacaggcatgtgccaccacgcccagctaattttttgtatctttagtagagatgggttttcaccatgttggccaggctggtctcaaacccctgacctcgtgatccgcccgcctcagcctcccaaaatgttgggattacaggtgtgagccaccatgcccagccaatattttttaaatgagtaaacttacgtaactattctgaatcacgctctatccataagtcataatttccctacataatagaggtggatttgttctagctcaagaatgccaaaggtttggatggtgtgggaatattgtattgggtctttatataatggatccattcagggactatgtttttattcttccttgtttgtttgttttgagacggagtctcactctgtcgcccaggctggagtgcagtggtgcaatctcggctcactgcaagctccaccttccaggttcagccattctcctgcctcagcctcccaagtagctgggactacaggcacccaccatcacgcctggctaagtttttgtatttttagttgagatgggatcaccgtgttagccaggatggtctcgatctcctgacctcgtgatccgcctgcctcggcctcccaaagttttgggattacaggcgtgagccaccatgcccggccatgctatactgttttaataagaagagatggcaacttcaagaaaaatgatgtaaacagtgtgaaaactggtccctaccatactgatctttcatctcagaccacatgggtgcatcttgatgtaatccacagtaactagtttactagttgtcatatttttcatatgtgttggccatggaatttttctcttatttagtcatctgtcattttaactacaataatcctatcccaaaatttcactttaagccgttgtctcagtaagaaacatgctttcttcaagcatatattgggtttatctacatatgaggcaatgagggatggtgggaagatcgcagatatcgtagtcagaaggtgtggttatgcattatatttcttccacctttttgtttctgacctgtcaaggggagacactacctatctaatcagatttttatgagaatgaaagcaaatactttatataaaagtgccttgtaaactctataaatgctagttatctccatttttttaattggctgatttgagaggatatcagtacttttcaatatatgaatttctgatttttattgactctttgtagttacacattttctaattgtaaagctaaaatgtttgtcacccttgtacataatatattatccttctgatttgcaagtaagcagtagtgcaaatagttcatgtttccatcacttttttccacatgatagaattatctgtaagcttcaggtgatatgtattgacttgcgatcattgctccttgtaccaaacagctcctaacttttcaccatatcaatggaataactatgtaggcactttagggatgagaaagctatgtaagacactaaccttacccccaaaaagaaatattactaacatttcatcttctgcattttaaaaaatctgcattgtcagaaggtctttaaagactatttttccaatgactcgtccttggctaaacaaaagaagtacagttttagtcttccattgctatagatgtttgtagctttaatagtgattgatgaataaatatttaaattgaaacttataaagttgttactgaactttaaaacattcaaaacgtacaagtgttatgatgttctttctttgtattttaaaaatccattattggtgttattttgcttccttttcaaaagattgaggcctaaagaaagatttagtcaggtggactaaacaggtctttcctgttaaactgttttttcaggttttctgagacaagtggaaaatctggtcagaaacacctgttgttcatgtcatttatacttgaacctatgattgcggtcaactaaaattcatgtgacatttggttgtttttatcttgaaaggaatttctgcttcaggttgagaagattcataacccaaattttttctctaatctgttgtgaggaaataaactgaggacacacacacacacacacacacactttctctcacatacactttccacctgagtcaaagctctaagttatgtttacagaatttcataaaattatttcttatttttttgcagaatttttgattgattaaggtcattctacccttaatttaagaggaatgataagaactttgaaaggtcagatttaaaaggttatgaaatttaagggtgaccacttgatatttgctagtgttgaaatacaagtttattagtttctgcaggtataagctgaaagatgctgcctcttctatattgattagctgttataaataaaatgcaggaaaaatgttgctaattcaaacaaatgagaaaaggttttctgaaaaagtaaaaattcagaattatagactttttaaaattttacaaattttgataaaatgctaaaagtcagctaagagcagtccttagaaaatttattttaatgagcaggtaggaataattgacaattggaatattgatggcttacaattatgtaacttacagaattccttatgtgcctgaaaacagtttgttttgaaatacttcttccccacacccatcttaattcacttttaagaaaggactcagcaattaattgggtgagtcttttcttaataattagcaaaatgacaagttttataccagcttcagtcctaaaatctatcgtattttttggcaaattttgaaagatgggcaagatttttctttcatactgctgtatgtatctatcatttgaattcggttttactgtaagagaatcagaatgcaaaatattatggtaaaaacctaggcctgtgtaggaaagaggtgtttaaagtgaggctggtagctttgttgagattttaatgtttcggtcagagctcttgtcttccctttggcctgagagtttgtatcttgtagaatcctttcagatgtatcaaaaagtttgaatcagagttaaaacttttatataagggtatctaggaaggaagtcctgtatctgccttttataacttatggaaacccccaggtttgtataagtataaaatgagataatgtgatatggtgaaatgagatagtgtgtatgaacatactttataaactataaagaactgtagacatttgtatattattaattatcataattctttcacggatatgcttgtttcctgtgacaccatttttctttttttcttttttttttttttggagatggagttttcttcttgttgcctaggctagagtgcaatggcgtgatctcggctcaccacaacctccgcctctcgagttcaagcgattcccctgcctcagcctccagagtagctgggattacaggtgtccaccaccatgcctggctaattttgtatttttagtagagacagggtttcgccatgtaggtcaggctggtctcgaactcccgacctcaggtgatccgcctgcctcggcctcccaaagtgctgggattataggtgtgagccaccgtgccaggcccatttttctttttttaaacttagaaatgccaaataaatgcgattaatatttatcaaacctcatatgtgccaatataagccctattaataatttaaatgtttatgtttttttgtttgtttgtttttgtttttgagacggagtctcactctgtcgcccaggctggagtgcagtggcgccatcacaactcactgcaagctctgcctcccgggttcacgccattctcctgcctcagcctcctgagtacctggggctacaggtgtctgccaccacgcctggctacttttttgtatttttagtaaagacagggtttcactgtgttagccagtatggtctcgatctcctgacctggtgatcctattgcctcagcctcccaaagtgctgggattacaggcgtgagccaccatgcccagcccaataatttaaatgttaattgttctattgaagtaaaatatttgtctctttgttactttttactttatttttaaaagtatagaagttatagatgatggctttctttttgtaaaagattcaagaatgtcaaagcatatagggaaaaatgagaaaggccatctctaacaccactttcctttccctctccagagttagccaaaatttgggatatatctttgaagtttgttttctttatataatatttacattcatatacgtatgtgcttttttaaaaaaatgaacattaatggaattatactgcagtttacatttttcacttgcaaatattccttggatagctttctgtgtcagtgtatgtaagtccccttcattattttggacaaatgcagagtattctagaatattgccacataatggaaaatataagatccatgaacacagggaccttttctgttttatttactgctatgactccagttcctcagatagtgcttggtgtctggtaggtattcagtaaatagaattaatgaataatttatttaacatatggattatttctggttgtggctgttgaaaaaatactgttgtgaaaatgcttacttgcctccctgtgcacacaaggaatcattttctagggtagccatccaaatgtcttttcaaagacatggtttcattgtcttctagtttctagtgttgccagtgagagttatcataccaatctcgttctggtttctttgcaggaaacctgttttgtccctcagaaaggttctaggactttctcttcacctttggtgctctgaaagtttacagcagtgggtctggacagatgtgtgcttcttttcatttatcccgatcatcactcactgaaccctttaaactgcagaggcacacctttcttcagctataggaaatttttttctcttctgtcttttattgtttcttctctatgactctttctgttctctccttctgagactcctgttagatcacagttaaaacttatggatatttctttcatgctttgtagcctttctgtctcactttctgtcattttgtgggatttggggcggaagggaagataaataactgtgttctgtttgccatcttcacccagcttcctgccatagttctttttatcccacaaggatgacttttttttatatctgtcacttcatttgtctcacagtctcttcctaaaaaaaatatgactcatatttcataataattgatggaaggttgatatttatttaacatgcgtttgttttatagtcagctttttttgaaaatgctttttttttcaaagccatgataccaatttaaaaattaggctgtgttgttttgtgctattggtagtgagcccagtcgctttaaaacacgtgttggtatcttaatcactcatctggtccaggcagctccaagtgctgataaaggccttgatgcttctccagatgtctaaatgctagctccaggtgcagtaagcagactatttggagctggcacatagattctgaagcacaatgtattaatacaaatgaaagttttaggttcttggtctcctagagtaatggttcttaagcctggttcagtaccagaatcacctgtggtacttggtaaaactataaagaccctctaataggcctgttaaatcaaaatcccgtggggaatgggactgagcgcctgtatatctctgaaggctctggaggttattctgatatgcagccaagtatggctgtgttttcatttctgtatatattttctttttgtatggatttttcactgttcttactctctgtatgtattttttcttactcatgcctcatgagttaaaatggctatacagtgtcccttggtacagatgtgttctaatttacataactgatcccctcttggtagacattattaatatgcttcccatcttttttcataacaagttactttagtagatatacttgtacatataactttgtacacatttgtgaatatatttaggggataaattactagaagtggacttgttcagaggatatatatatttgtgaatttgagagatgtgttttctttgattccaatttttaaaattgttttaaaatgcccataaaattgtccgggcgtggtggctcacgcctgtaatcccagcactttgagaggccgaggcgggtggtcacaaggtcaggagatcaagaccatcctagctaatatggtgaaaccctgtctctagtaaaaatacaaaaaattagccgggcgtggtggtgggcacctgtagtcccagctactcgggaggctgaggcaggagaatggcatgaacctgggaggtggagcttgcagcgtccgagatcgcgccactgcactccagcctgggggacagagtgagactccgtctcaaaaaaaaaaaaaaaaaaaaaaaacaaaaaacagaaaaccataaaatttaccgtgtaaccattttaaatgtacaattcagtggcattaaatacattattaatgttgtgcaaccatcactaccattcatctccagacctcttttcatcttgtaaaactaaaactccatacccataaacagtaactccccattccttcctctccctatcccctggcagccaccattttactttctgtctcttggatatcagctactccaggaacctcatataagtggattgtacagtatttgcttatttaacttagcatatggtcctcaaggttcgtcatgttgcaggatatcagaattttctttctttttaatgctgaataatattccattgtatgtacgtaacacattttgtttatccattcctctgtcaatggtcatatggatttcttccacattttagctattgtgggtaatgctgtcatgaacaaggctgtacagatatctcttcaagaccctgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaactgaatatattcttaactattcttaaatcttggaagtccttacattttgtttttatctcttcttaggccagtactaaagtggaagtggacatggagaaagcagaaagcctgcaagtgacgagaggagacttccttgcttctttggagaatgatatcaaaccagtgagtatgcccattgagtgatatataggccaaaaagtaatgataataataactcaggcgaaaagtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcactcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcatgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattgcacactccttatgagaatctaatgcctgatgatctgtcactgtctcccatcacccccagatgggaccatatagttgcaggaaaacaagctcagggctcccactgatgctacattatggtgagttgtataattagttcattatatattacaatgtaataataatagaaataaagtgcacaataaatgtaatgtgcttgggctgggcatggtggctcgtgtctgtaatcctagcactttgggaggctgaggcgggcggatcacgaggtcaggagttcgagaccagcctgaccaacatggtgaaaccccatctctactaaaaatacaaaaattagctggatgtagtggtacgtgcctgtaatcccagctactcacgaggctgaggcaggagaatcgcttgaacccaggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagtattttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctcccgggttcaagcaattatcctgcctcagcctcccgagtagctgggattacaggtgcttgccaccatgcttggccgatttttgtatttttagtagagacggggtttcaccatgttggctaggctggtctcgaactcctgacctcaggtgatctgcctgcctcggctttccaaagtactgggattacaggcgtgagccactgcacccagcctcagatttaatttttgccattcagttaggtgtaaaatgagatctcatttcagtcttgatttgcattttagttattagagaacttaagcatttctccatatgttaattgaccatatgcatgtattgtgtgaaatagtgtccaagtcttttgcctgtttttctgttgtactgcttatttgattgatacaagttctttatatactctttttttctcaattttgtattgtgttaaaatacatataaagtttaccattgtaatcattttcaaatgtatagttcagtggtattaagtatattcataatgttgtataatcatcaccaccatccatctctaaaactcttttcttcttcttgaactgaaactctatacccattaaataataactcttttttccctcccctacaacacctggcagccaccattctactgtccatctttatgaatttcagtaatcttaagtacccatgtaagtggaatcatagtatttgtctttttgtaactagcttatttgacgtagcataatgtcctcaagggtcaaccatcttgcagcatgtcagaattttcttcctttttaaggctggataatactccattatatgggccaggcgtggtggctcttgcctgtaatcccagcacttttggagattgaggtgggtgggtcacctgaagtcaggagttcaaaactagcctggccaacatagtgaaaccccatctctactaaaaaatacaaaaattagccaggagtggtggcacacacctgtaatcccagctactcgggaggctgagacatgagaatcatttggatccgggaggtggaggttgcagtgagccgagattgtgccactgcacgccagcctggtgacagagcaagaccctgtctcaaaaaaaaaaaaaaaaaatccatgatatgtacataccacatgttgttatccattcctctgtcaatggcagccaggcttctgccacgttttggctattttgagtaatgctgtcattagcatggctgtacagatatctcttcaagaccctgtttttagttctttcgggtatatactcagaagtggaattgctggatcatatagtaattctatttttaattttttgagggaccaccataccgttttccacggtggctgcaccattttacattcccaccagtggtgcacaaaaattctgacttctccacatgctcaccaacaaattattttctgtttttttggtagtagccatcctaatgaatatgaagtgacatctcattctagttttgatttgtattttcgtaatgattagtggtgataagtatcttttcatatgcttatcaaccatttgttacatatccttttttttttttttttttttgagacagtcttgctctgtcacccaggctggagtgcagtggcacaatctcggctcactgcaacctctgcctcccaggtttaagtgattctcctgcctcagcctccccagtagctgggattgtaggcacccatcaccatgcccggctaatttttttgtatttttagtggagacagggtttcaccatgttggccaggctggtttcaaactcctgacctcaagcgatccacctacctcagcctcccagtgtgctaggattatgggcatgagccactgcacttggccaccatttattttatatatatatatatatatatatatatttttttttttttttgagactgagtcttgctctgttgccaggctggagtgcagtggcgcaattttggcttactgcaacctccgcctcctgggttcaagtgattctcctgcctcagcttcctgagtagctaggactgcaggcttgcgccaccatgcccgactaatttttgtatttttagtagagacgaggtttcactttgttggccaggatggtctcaatctcctgacctcgtgatccacccaccttggcctcccaaagtgctgggattacaggcatgagccactgcacctggcctgttatatattcttaacaataattatttgttccaagtatctcctttaaagacaaaagccaatttggttagccctgtctttttattactattgtgacttttaaatataaaataatcattttcaaaagtaactccaagatttttttaacaacaagtaatttggccatgaggaagtgacaactaaaaacttaattttatttattccaagggtctggaggataaaaaaaaaatgaaattatgggatatgtaaggaagatatacacgttatatatcttgggagagtcactgttttatggttcaggcatcttaaagcttctgctgtgaggcttggagtatataactggaaaaattaaagacaaaagccagcctataatttttttttttttttaaatgagatggagtcttgctgtgtctcccaggctggagtgcagtggcgtgatctcggctcactgcaacctccgcctcccgggttcaagcaattctcctacctcagcctcccaagtagctgggattacaggcacacaccaccacacccagctaatttttgtatttttagtatagatggggtttcaccacgttggccaggttggtctggaactccatacctcaggtgatccacccgcctcagcctcccaaagtgctgggattataggcttgagtcactgcgcccggccatgaaaatttcttagaacagccatttagccagtttggattagtttcatcattactttttacactgctactgaatttgccatatctaggccaaagaatgagaaccttcctctgtattcaggaatcaaaggaccagtatatgcaaagagactacgtaaaaagtggtctgaaaaattattttgtggcaaagtaatagagatatgagatcactggatactgtttcaaagacagtattacaaaaacagctttatgtgaggtgcatgttctaaagaactattaaaactattccatacatcaggtaatcaaaagttgaattttgagggatgtgatgatctttaaaaaattgaaattctcaagatacatgatctttacatgtacatgatctttacatgtagtaggttatgttttcctatttattctgttaacctcatgaaaatccagttcaattgtaaatactaaagttattgactacttttggcagctgttttgatgggaggtataacctttgagattaaaagttgacaatgaagaagggtgcaatttaagctccaatatgtagtgaacacaaatagaattattatctgaaataattgcttttatatccttcttattacagctcctcatttctatctcatcctaaatcttatatttacacatataaacttaacattggtgccatttaactatgtcccctaccacaaagttgatgtgaacatgatcttctcattaccatttcgtattctcatgttaatccatagcacctgcagtcagtgttaaggtagcatatttgtctattgcgctgtttctaagtccataatctcttttttcctttgttcttaacagaacagcctcaaactgcatactgttgataaaaataagcacattggaacatattctttctctcaggaattatgagggtttgagtctggtggaatctcagcctagaatccattgtttttattccattaagtcacccaaagcagctttttttttcctattgggaaaaaagttaaatgagaaattatacaagttgttttgctttccaggctttttatattaatatgggatagtgatcaatacctttagcatgtacgaattataactcgtcttttatactgttagtttttaacactaaggctcaaaatgctttagactcctttttcttaataggcctttggcacaaaccaagaagattatgcaagttacattatgaacggtatcatcaaatggggtgacccagttactcgagttctagatgatggggagctgctggtgcagcagactaagaacagtgaccgcacaccattggtcagcgtgcttctggaaggtgagaatgaatgaggagatggcattaaaagttaaaggaaaaaaagcagcattttttaaaagcccgtaagcacattctagaaaagtgaattctttttcgtttttaaccttgttcttgatctgaaaatagtaatccaatctatgtaccaatattgtgtacaaattaaaattttcttggggtagaatgttagtgaggaaagatagcaactagttttcttgtaggattatatctgtatttctgtggcacttaatacactgaatgatgccacttagcctcaattcaattaaataaatacttactgagtacttgtattttagtcattgaactagttgctggggatacaaagacattcaagtgttcattcagtctggtcatgaacaaagacagtgtaaagaaattcctgactacggtgtatgtgtgtaaaggtgtgtgtgaatacaagtcatttagcataggggtggtcagggaaaactagagatgctatttaatctaggccttgaaagaccagttaggattttattgagtagacagacaaaaggggaaggacattccattcacaaataattaatttacagttataattagtatgacggcagaaaagttcagtgaggccccatgacaagggaacctaactacctctaaaggtctgggggatgagagctccctgggagaaacatattaagccatgacttgaccaatgaggagactctggccagccaaagtcactggggaggatgtttgaggcagagcatgtgaaaaagtcctgggcaggaaggagcttgaaagagaaagggagattatcctgacatgagactgtagaagcagatagaagccagttcatataaaaccctgtaggccatattaaagatttaaactatcttaggggcaatgggaagccatttgtaggattttaagcagtgaagccacatcatcatcactgctttatgatggagaatggattggaggggcaaaaagatacagaagagactaatggttagaagcagttggattagtcttaatgagagtcgattgtggtttgaagtatgtggagtagtgtagatggagataagtagactaattagaaatatttagaagatagaataaaaatgacctcattattattgtcaatcataattatgctagcagtttttgagcccttgctatttgccagtcactctactagcactgtgcacatattatctatttaaaccccacttcagtcctccaagggtagatgctgctgttgtctctattttgtaggtggggaagctgaagcctagaaatatttgttagattggatgtgggcagaggtatcaaacatgaccccctgggttctggcatacatagcccgataaatggtgctgtttactaagattgggaacactaatggaaagcagatttctggaagaaagatgatgagttcagttttgaacatgttaaattcaagggtcatataggagaagtaaatcggaaatgttgagcagcctgttggatatgtgggtctggctagcagtagactcatgagttgccagtatatagactgtggttgaagccatgggagtgaacgaaatcacttacagtgagggtgtgggttgagacgaaaaggaggcctagaacttgtctctgaagcatgttaacacgtaaggactaaacagagcagaaaaattgacaaaagagactgagcaagagtaaccagagaggaaaggggaaagagagaatgtgtgttacagaagccaagaaaagaaacatattttaagaaagaggggaattatgaattgtatcaaatgctcctaagaggctgaaaaagataccaaaatgtttgttgggtttgatgacatggagatcatttgtgaccttgatgggagcctgttcagtgtaatggggatgggagccgtaagatttagtgaggatgggtgggaggtgaagaacaaaagcagccagtgtaaataattacataggcaagttccattttgaagggagaagaaggtgcagttttgaggggtatgatgttcagaaagagttttttgttgttatgtattaaactgtcagatagactagaacatgctaaaacacttttggaaaggcttcagggaagaggaagaagtcgaacatatgggagaaaggaacaatcagtaatgtcatgttcctgagaagatggaaaggaagatttgattggtttatggttgaacgagggacacagcttccaaaacagggaagggaaggcagggatgtctaaatgtaggtaagttcgtagatttgcttgcctttatgagaaggcctgagtctttagaattctaactttttacatcacatttgcttctaataaggcagttttcccctgcccccaatatcagctcttaagattgtctttttttgttagacaaatgatttgatagaactaacaacataagtactaatatgcatttgaatgcgttcttttaagaagcaaaacccttacactctgtatattttgccaaaagtttgaaagattaaggatatgtgagaatgtcaggaggcatgtatttcaccatacttttgagaaatgctaattagttcattaagtttagttgctaataaataagagaaaacatgtctgctgtgaaattgtgtcaggaaatgttaatgagcaactagtcgagacctcagtatgttctggataaaagtttaaacttgttttatttccctttgcttaggttggcttttttcccctgacttgctcatatctttatgcaggccctcctcacagtgggaagactgctttagctgcaaaaattgcagaggaatccaacttcccgttcatcaagatctgttctcctgataaaatgattggcttttctgaaacagccaaatgtcaggccatgaagaaggtatcaagattttactttcattttaatttcctatctcttaaatgtgtgtgtgtgtgcacatatatatgcctttgtacatgtatacatataaacccatagcaactatgttcttctcaagtggaaccaaattatcagcagaatatgggggaagcagtgactgttttagattttctaactttgtaatgtattttattgagtacctttaccttctaaattatgctttgtttaatacatattaagtttcattgcctagttttgtatcaatttgattaaaagagttatagttgaaagtgtttgaataaagtggacaaattcatttaggattttttaaagttctttcattattgtacaaagttgaactctttggggtcaattaagttgaggaagacagagatgtatcaatgggaaaatagtcccaggaatccctacaaaaggatagttttatattaggtaataatcagaatctgcttggtaacttaatgcagttctcatacatcttcctttctccaagtgccactcgtcaccttcttaattaacatggccactttctaccatcagtgaagttagaacagcatagaatagaatcctagagctgaaaagactgtaagaccatttggtccatctctcttacattcaagcaagtgccatgcaacaacaacaacaaaaatcaatgatgaagactctaaatgg

SEQ ID NO: 32 - DNA, 578687 bp, Homo sapiens
aaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcgtagcccgggcggattcagccccacaaaatgggcgcagtttgcaaacagccccccggcctgggcgccgagggccagcggcgggcgggggcgcgcgacggcggctccggcccgggcccgccgctctcctccccccgacgcccggagccgccctgactttccgggcgggggggcgaggcagagggggaggggaaggcggcggcggggagcggctgctttttcttctctttcgggccctttcccggccttgctccgcaccgacggggcccgagcacggctggagaccgcagcccggccgggagggcgggcgggcgggggcagagagtgaaaccgcccccccgccccgcacaaacaagcaccgccgtctgcagcccgaacccgcacccaggccgccacccccggccgcctctttccagccggggagcgcgcttcagccgccccccgcgccgccgcggcgagacgagtcggcttcgctacggtgctcggttctcccgccggctcggcgagcggtggcggcggtggcggcggcactgggaaaatggcggccgagctccttttccctccccccctttaatctgaagcggagggagaatggagcgagcgagcaagcgggcgagcgccggggacacggggaggagggacagcagcgcctccgccggctgcggctgcggcggcgaagggccgctccaccccggcgcgccgccagggggcgcccgccgcgccgcccccgcgggccgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggtgagtctaacctgaggcactgacgccgtcacatgccctccgtgctggggccggcggtgcggctcgccagttgaggggcagggcgggccggcgccgcggagcgagaggacgtgagcgaggaactgtttgcactgtgtagtaaagagggtaaggccgtcggcaccacactattccaaggctaaccctgcagaaagctccctgaccagtgaagcggcttccgccgcccgccctttgtccctagcagccagcctccgtatactgcagcacggctgggcactagccccagcaccgcgctccgcagccaccagagttgggcggggtggggagggtgcacgtagtcactgcgcaggccccagccagggcccgcgccgggccagcccgggaagggacagccgggagccagaggggaagtgatggccccgccggcgccgggcccgctgggaactgtagttttcgtgaagaaacacgcgtcttgttttgggtgtcatggcttggcagatccgccaaaacaggcaaatggcattacacaatgagtatttatgcttcctgccgccaccaaaaggaagttcactgccatgctaaaagtttaacaaagaactccataaagaaacacaagtctcacaacaaaaagccaacttcccacctcgttaccagagttggtttaaagtggtggcaccttatcatttctcatgaccagtttatcagtacagaactttatattgtccccaaaataggacctttaaaataatggaacctttcctagacttaaagaattcataaacataatgtaatacaaagtgtcacacaaagtgtaattctaccaccctttaaagttgccaaaagatgagtggagtatcttgagatttaaaagactaatctaggattcatcaaaactggcttaaatgactgaagaaaaaatcgttcaaatcattaaatcatcaaattcggcagataagaagggtatgtatgctctactaccaaaaaggaagacgcaaaatgcttcacacttttttgtggcttaccagaaccaatatccggcattatacgtcacttctgcttatcaaaaaacaccctcacagtcgttacagaacggttttagtcttcccacaaagttacactaactcacctgcccctgcaacatctgcacctaggtttctgcgaatttccatttgtactcctaaaatcacactctcaagcatagtcatagttctcaaataccaaaggcaggcagtttggagtcatagggtcaaattacacaaagaataaactaatatttgtatacacatccaaaagaggtctttagtcttggatttttaatttacaaccctggggaaaaactttgacttttttattgtacacacatacacacataaatagtaattccacaaaatacagtagaagggtattggaccaacagatggcgaactagagccccaatctgaggctcctgaaatctaaattagcagaatgaaaaataccaaataaggcaaagccctttgcagcgtatacttaaatattaaattcagacacaccataacaaaataatcttactgctgctccaaatttttaagactgaactgtcagatttaattaggcaaccaaataagcaagattatatgaaatatatttttctaatggattaggagaaaactggaaaatgctcatttttaaaaccatgtatttgggggaactataaattccagtttcccctttctctcattgcttagtgcaagagtcaagagttcacagggtttatggcacttaaatcagtcaacctgttgtatattcttatctaaaatcagacatctttcttattaggcatccacttgtacttttatttttttgacagggtcctgctcggttgcccaggctagagtgcagtggtgcaatcaaactcactgcagcctcccaggctcaggcgatcctacctcagcctcttgagtagctggcactacaggcatatgccaccatgcccagctgttatttttttcactcctttttgttttggtagatacagagtctccctatgttgcccaggctggtctcgaactcctggactcgagtgctggcattacaggcatgagccaccacacaaaaatcttatgaagagaaacaaattttcttaaatttccccccaaaaaatagtggatgtccaaaaggctgattgaaaacacctacatacaaaataaaacaaacaaacaaaaaaagatttaaagaaaaaggcctggtgcagcagctcactcctgtaatcccagcactttgggagggtgaggtgggaggatcacttgagctccggagttagagaccagcctgggcaacagagtgagaccctatctctacaaacaaaattttaaattagccaagtgtggtagcatgtgcttacagtcccagctactccagaagctgaggggattgcttgagcctgggaggtcaaggctgcagtgagtcatgatcatgccattgtagtccaacctgggcaacagagcgagaccatctcaaaatgaaaagtgataaaaaaataaaaacaccaacatatttcaaatcactcttggaatagtcatgttgactctccaatatccactctattctgattagttttaacccattctctttgccaatgattggttaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagcctgaagatgccaccaacatcaaagggaatagagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaatgattgagttctaatgttttttagtatttgtatcttactttatgattacagtattttatataactaatcttattatttcttcctcagaaaagacattccatggccaggcatggtggctcacacctataatcccagcactttgagaggccaatgtgagagtattgcttgagcccaggagtttgagaacagcccagggaaaacagcaaaacttcatctcttcaaaaaataaataataaaaaaatttagccgggggtggtggcatacacctgtagtccaagctactcagaggctcaggcaggaggatcacttgagcccaggaggtcaaggctgcagtgaaccatgatcacgccactgcaaaccagcctgggcaacagagcaacaccccgtctccaaaaaaagaaaaagaaaggaagggaggaaggaaagaaagaaaaaaggaaaaggtgttccctcttacacacagctctgtatccatccatctttgtctgtgttctctctacctagaaaaagaggaccatccctcattaccaccattccttgttaattcctctctccaatccacctacaactcatgttatcctcttatattccaccacaccactgttatcgtctactcacttcacttgacaataatgtaggctgggcgtggtggctcatgcctgtaatcccagcactctggaaggccaaggcaggcagatcacctgaggccaggaattcgagaccagcctggccaacatggtgaaaccccgcctctactaaaaatacaaaaagtagccaagcatggtggtgcacgcctgtagttccagctactcgggaggctgaggcatgagaatcacttgagcccggaaggcagaggttgcagtgagccaagatcacaccactgcactccagcctacgcgacagaaggagactgtgtctcaaaaaaagaaccaataatgtacagagttggcactacattacccttggttaaatgctgtctgtaattcctctgagtttgttttcatataccagtcttgccacctcaagccagcctgaaagcccttgcaggcaggaactgtggttgttctaatttaagatctgtaactcatctatagataataaacgtattccaaaaaggcactctctaccttccctgccacagaccttctaaacaagccagaaattcctaaacagaataatctcacaaattcagtacctcgtatgtccaaactaatctcaaaaggacaatgaataactttttttgcacttaagaaaaagcaattattatatattaactcaggacaagttctaaagcctaggccatttagtttcaaaagcacaggggcccatttttttggttacttacctaggacctagcccagggcctggcacaaaagagacacatcataagaactgactgaataaatgaaaaaggtagagtgtagtacttaagcacacaggacctaggtagcccgattctaatcctgcctccctcacttattctttgtgttactttgggcaaagtacgtattctgctctgtaaaatggagatagtaataccacctacctcttaagtttaactattattattagtgaatgaagctattttccacagttctaaactttaaaggttaaaatctgagtgaagcaaaaatcagcacctctttcctaattcaaacttcaaacacctatctacttaggacttggacctactttaattaaaaaaaaaaaaaaaaaaaaaaaaaaagcctggatgtggtgactcacacctgtaattctagcactttgggagaccgaagcaagtggatcacctgaggcctggagtctgagaccagcctgggcaacatggtgaaaccctgtctcaactaaaaatacaaaaattagcctggcattgtggcacatgcctatagtcctagctacttgggaggctgaggcaggagaatcgcttgaacccacaaggtggaggatgcagtgagccaagatcgcaccactgcactccaacctgagtgacagagcgggactctgtttcaaaaacaaaatccctgtctagactctagcaaacaatgttttcattcatgaacttagataacactatatataaaaatacttttagctccctaaaaacatattctgagaatgattatttacaatcataaatctaatgccacattaaatacttcaaatacatttaattcaacaaaaatctagtgagtacctattaagctcaagaatttattctagatatcacagaaatgaacacataaacctatgtaaaaacccatattaaaattataaaagaaacatctttaagctgaaactgaggcatgttctcacattaatatttaaccagctaaatattaaatagccagagtcaactaaaccaaagttaagaaatttaagtcaaaaaatttaggatgtagaaggaatatgttcagccgccacattttattagtgtgaaaatgaggccaacagaaagaagccagttaagagattgccaaagcgtcaaagctggaatcagggtctctcagtcttcaattctcacttttcccacttctaattcaccagtgctactcaattggtgaactggatgtgcaaacatgctaaaggcattaaacctaaaccatactacctatttcacagtgtcacaagtataaagatttagccaaatgcaagtagaagaaaatcctcatactgattacaatgactacaaagctcagaaatcaagattttttttcattaaatggaggccttagctgattcaaaatatcatacagtatttttatgtactgactgaatccagtagaaacaaactttcagtaagattaaacaaaagcatttcataaatggcaaagtattacaagaatgcatagcattccttcatttcaatccaacctaacaagatattttcctcctcatactactgatacaaactgcaggatttacataaagatattattttgccatctcaccacagaactgacccaataattcatacaaaagaaaaactaattattaggcagcctcctaatttaactgtgttagtaatgagaacaatactgttgtaggttaaacctaaatgtactagtaagtctagaaataatttactttaggataattcagaagacaacattaaagctcagctgaatacaattatatcactgaaagaaacaagtcaggttctctcaggccatcagctattgttaaaatctaacacccaagattgttggtcttctccacagtggtggatttaatagcagctaccagcactcatttctagtgcaagcagtttaagcaggattttatacgaacattttaataaagttcctcaatgagtttacacacacacacacacacacacacacaccctgattattttggtgaattttagttaattctaatgtttttaactttagaatattttaaaattctcaaataactagaatgtgtgaacgttcaatgaccaaacatagaaggagtattctaatatactgattttgcagattaagcaatctacgcaggacccaaactttttatcagataataaagctgagtgtcagaatttggccaaaatgtaccaagaaactacctgagttcttttccaaaggaaacataaaggtaaatatgcagaacttcaaggcagctgtgagcagccaagttgtggagggcctgacaaaagtgagtcagaagggaaaatgttcaaagagaaaaggaggcagcaggtgtacaaggcaaaacacaccttaaaaaatatctttacaggctgggtgcggtagctcatgcctgtaatcccagcactttgggaggccaaggtgggcagatcacgagatccggagatcgagaccatcctggccaacgtggtgaaactccgtctctactaaaaatacaaaaaattagctgggcatggtggggggcacccgtagtcccagctactcgggaggctgaggcagcagaatggcatgaacctgggaggcggagcttgcagcgagcggagatcacgccagtgcactccagcctgggcgacagagcgaaactctgtctcaaaatatatatatatatatatttttctttttacgtcagttgctgattctaagttatgatgcaacttgtaaaatcttgttctgatggcatggcaaacctagggactttggaagatggcagacctgtttcctccaatgaagcagcataccattcttggaaagggaattactttttttttttttgagacacagtctcactctgctgcccaggctgccaggctggagtgcatggcaaaatctgggctcaccgcaacctccacctcctgggttcaagcgattctcctacctcagctgcccaagtaggtgggactacaggcgcgtaccaccatgcccggctaatctttgtatttttagtagagacggagtttcgccatgttggtcaggctggtctcaaaatcctgacctcaggtgatccgcccatctcagcctcccaaagtactgggattacaggcgtgagccaccacgcccagcctagaacattatttttaacccactaattcttggattcttgaacttgtttctatgtacactcaggaacatacagctacaaacggggagtaaccaaagccactgaatatatgcaggagcaacttttttggagtatcaatttaatcaaggattatagtaaaatcagatatacttttgttaaaataaacacaaatatattacaggttgaccatccctaatctgaaaattcaaaaccctccaaaatctgaaactttttgagtgccaacatgacacctcaaatggaaaattccacacgtgacacctttgcttctgatggttctctgaaccatcagaaacactgtttatttcaagaacaaaattattttaaattttgtataaaactggtcggttgtggtagctcatgcctgtaatcctaacactttgggagaccaagatgggaggatcatttgagccctggagttcaaaaccagcctgggcaacatagtgagaccctatctctgaaaaaaaaaaaaaaattaagtccaggtacagtggctcaggcctgtaatcccaacactggaaagccatggcaggtgaatcacttgagctctggagttcaagaccggcctgggcaatgtagcaaaacctatctctaccaaaaacacaaaaaattagccaggcatggtggcatgcacctgtagtcccagctacacaggaagccaaggtgggagaatcacttgagcctggaaggtggaggctacagtgagcagagatggcgctactgcactccaacctgagtaacagaatcagaccccatctcaaacaaacaaaaaaattagctgggcttggcaccgtgcatctgtaccagttagtaccagctacctgggaggctgaggcaggagaatgacttgagcccaggagttctaggctgctgtgagctaggatcacattactgcactccagcctgggcaacagtatgagacatcatctcttaaagaaaaaggtaaaaaaaagaaattatcttcaggctatgtgcataatgtgtacatgaaacatagaatttcatgtttagatttggatcccatctccaagatagtacattatgtacatgcaaacatcccaaaatctgaaaaatctgaaatccaaaaaacttctggtcccaagcatttcggataagggatattcaatgtatacagagcaaaaggcagaattctcactgtttcaagatagaaaaggagtcctcagagagatatgtcctgcttgtaacaaacagctccaaacagccctagaccctgaaaagtactttaaggaaagataaagaggtactggtttagaccatttatagataaatatgcatggctaaaacccctgaatgtaatccttccaggcagaagataaaacctgaaatctaacgtataaattgtcatgggtacaatattataaaagagaccataagttaccgagaacatgactggaattcaggaaatgctaaaggtcctgtcttatctctgtaactcatttacaaagaaatcatgtatgattttctcaactgcaatcttttttgtttctgaattagactgacaaaaattatagaatataatattcaatattttccaccatattccaaattctcactatcacatttaaacacaattttatctaatgaaatgtgtcccaaatgaaccaactttaaccagcatcagaaaaaataaaataaaatagttaaatgaaactgtatcttctttggtataagaagtccttcaggccagacgtggtggctcacatctctaatactagcactttgggaggccgaggccagtggtttgctagaactcaggagttcgagaccagcctgggcaacatggtgaaaacccgtctctactaaaatacaaaaaattagccaggcgtggtggcatgcgcctgtagtcccagctactcgggaggctgaagcaggagaattgcttgaacccagcgggaggtagaggttgcagtgtcagtgagctgagatcgcgccactgcactccagcctgaacgacagagcagactccgtctcaaaaaaaaagaaagaaatccttcagcacagagggtaggaaaaaacaactactcacacttcccagaatacctaccgtggcaataccaaaatatgaccatgcttgttaatatttgggctacggcattaaatgtttataacataacacaaacacttgtaatccaaatgtgaatgattatcttcaattttcagtaaaataagaccctataaaagccctaccattaatacatattcattcataaacatactgagtaccagtggatgttaaacactgtagaatctctaaggaaagaatactcggtcactttataagctatgtggtagtcaagaaaaatcctttctactcattgatacgttaaatgatcaaaaaatccaaagctaaaaaatgatcagagaacaatgaaaaaattttagtggctttatgcttccaattccattttcttctggactcttttctgaagcttgcctaaatcatcccaggaatgctaaaattgggtgttatttatggcataaccaaaatgaaataacaaagtaagtaccccaaataaaactaggagaaaaaatccagggaaccaagcaggcagtaaggatctaaagttctatacttggaacctctaccctgaatgttaaataatagatgttttttaaatagttgactaccaagtgtggtggcatgtgcctgtaatcctagctacttgggaggctgaggtggagagactacttgagcctaggagttctagactagtctggacaaatagcaagaccctgtctcacgggtaggggagcaggggaaggcaaccaagctgggtgtgccatgtgcctctagtcccagctacttgggaggctgagacaggaggagtgcttgaaaccataggccactgtactccagcctaggcaacataggaagaccctatctctaaaacaaacataaacaaaaaggccgggtgtggtggctcacacctgtaatcccagcacttgaggaggctgagttgggaggatcacttgaggtcaggagttcgagaccagcctggccaacatgataaaatttttgtatctttagtctctactaaaaacaaaaattagctgagtgtggtggcaggggcctgtaatcctagctacttgggaggctgaggcataagaatcatttgaacctgggaagtggaggttgcagtgagcggagatcacaccactgcactccagcctgggtaacagagcaagactctatctcaaaaaaacaaacagttatatctttaattattatcttcattcagtaattaggcaattagaatttacaattgctaaatgaatgttcaaagttcaaccaaaattagtccaagatgaagccaagaacacatctcaactcattcaataaagccattattactctgatgccaaaaccagacatagatatcacaagacaactacagaccaatatatcttatgaatacagatgtaaaagtcctcaacaaagcaaaatgaatccagcaacatattaaaaggcttatacaccattgctaagtatgacttaatcccagggattcaaggttggcttaacttctgaaaatcaattaatgtaatacaccatattaataaaggatacaaaccacatgatcatttgaatagatgcagaaaaagcacttaacaaaatccaacatgctttcatgataaaaacactcaacaaagtagaaattgaagaaaacatcttcaatctaataaaaaatacctatgggggaaaaaaagaatacctacaaaaaccccatagctaaaatcatacttaatggagaaagcctgaatgctttctccctcaggtcaagaacaaaacaaggatatccactcttaccactctgtttaacactgcactgaaggttatggccagggcaaataggcaagaaaaagaaataaaaatcactcaggcttaaaaaaaagaaggaaaactacctttatttgcagatgatataatcttgtatatagaaaatcctaagaaaatcccacaaataaactattagagccaataaacacatccaacacagttacaggatacaagctcaatatacaagtagtaatcgtatttctatacacaagcaataagcaatctgaacatgaaaagtttttaaaaattccacttacaatagcatccccccgccaaaaaaaaaagacttagaaagccaagcacgatggctcacacctgtaatcccagcactttgggaggccgaggcaggcggatcacttgaggtcaggagttcaagactagcctagccaacgtggtgaaaccccgtctctactaaaatataaaaattagttgggtgtggtggcaggtgcctgtaatcccagctactcaggaggctgaggcagtggaatcacttgaacccaggaggcggaggttgcaatgagccgagatcacaccactgtactttagcctaggtgacagaatgagacactgtctcaaaaaaaaaaaaaaaaaagacttagaaataaatttaacaaaagcagtgacaatcttatactctgagatatataaaaattacaaaagaagttacagaaatcctaactaaatggaaaggccaggtgtgatggctcacacctgtaatcccagcactttggtagactgaagtgggtgggctgcttgagcgcagaagttcaggatcagactaggcaacatggcaagaactcatctctacaaaaatacaaaaatgagctagatgtggtggcatgcacctgtaatcctagctgcttggggggctgaggagggaagatcacttgagcctagtaggttacagctgcagtgagccatgattgcattactgtacttcactgcagcctggatgacagaacaagactgtgtcccccaaaaaaaaaaaaaaaaaaaaaaggaaagatatcccatgttcatggatgagaatggatcagaagatacaactctgttaaaatggcaatattccctaaattgatctacagaatcaatgtgatcccagcatacccaaaagaaatttgaataggaaaaacaaagttgggggactcacacttcctgatttgaaaacataattcaaagctatggaaatcaagacagtgtggtagtggcataaggataaacatacagatcaatggaatataagtgtgggttcagaaataaacctttacactgacagtcaattgattttatgacaaaaatgccaagacaattcagtggaggaaagaatggtctttttaagccaagtgctgtagctgacacctataatcccagcatttggggaggctgagacaggaggattgcttgaggccaggagtttgagactagccagggcaacaaagcaagacccccatctctacaagaaacaaacaatggtcttttcaacaaaccatgctgggacaactgaatattcacatgcagtagaatgaagctggaccactatatctcacaccatacacaaaaattaattctaattaaatttaaacacggattatagacctaaatgtaacagctaaaacaataaaattcctagaagaaaacaaagctaatcttcatttcatttggtggcctgacatcaaaaccacatgcaacaaaggaaaaaacaagtaaatttggcttcatcagaattataacattttgtacattaaaggacaccatcaagaaattgaaaacacaacccatagatgggagaaaatatttgcaaatcatgtatctcacaagggatttgtatctagtatatttaaagaactcttacaactcaacaataaaaagagaatccaattttaaaatgggcaaaggctgagcatggtggctcacaccagaaggagaggatcccttgaggcaaggattctgagacctgccagagcaatatagcaagaccctgtctctacaaaataaattaataataataaaaaaaaacaattagccaggcatggtggcacacacctgtagtcctagctactcaggagcttgaggcagaaggaacccttgagtccaggagtttgaagttccagaaactatgattgggccgggtgcggtggctcacgcctgtaatcctagcactttgggagtccaaggcgggtggatcatgaggtcaggagttcaagaccaacctggccaagatggtgaaaccccatctctactaaaaatacaaaaattagctgggcgtggtggtgggtgcctctaatcccagctacttgggaggctgaggcagagaatcacttgaacccaggaggcagagattgcagtgagccaagatagtgccactgaactccagcctgggtgacagagcaagactccatctccaaaaaaaaaaaaaaagaaaagaaaactgcgattggccactgcactctagccagagtgacagagcaagacctagcctaaaaaacaatagtgtataaaaataaaattaaaatgtgcagagaatttaaatagacatttctccaaagaagatatatgaatggccaataagcacatgaaaagatctcatcaggttgagcacaggggatcaggcctgtaatcccaacactttgggaggccaaggtgcggggactgcttgagctcaggagtttgagaccagcctgggcaacatggtaaaaccccatctctacaaaaaatacaaaaaggccaggtacagtggctcatgcctttaatcccagcactttgggaggctgaggcgggtggatcacctgatgtcaagagtttgagaccagcctggccaacatggtgaaaccccgtctctactaaaaagacaaaaattagccaggtgtgatggtaggcgcctgtaataccagctactggggaagctgaggcaggagaatcacttgaacctaggaggcggaggttacagtgagccaagatcacaccactgcactccaacctgggtgaaaggcaaaaatccgtctcaaaaaaaaaaaaagtttcaaagataaaacaaaaatcttgttaaagataaatacacgagatgctaaagaaataatctacttcttcaagtcatgctatcaatttgcaccaaaattttcatttcctatgtgtaggtgttgagggtcttgtacccatgataaatgacatacacctgttctgggctgacttttgttccccaaaagagatatatagtactccaaggggctgggcacagtggcacatgcctgtaatcccagcactttggaaggtcaaggccacagcatcgcttgagctcaggaattcaatatcagcctgggcaacatggcaagaccccggctctactaaaaatataaaaaaatagccaggtgtggcagtgcacacctgtagtcccagctacccgggaagctgagatgggaggattgcttgagcctggggtttagggggctggaggttgcagtgatccaagtgccactgcactctagcctggatgacagagggagaccctgtctcaaaaaaaaaaaaaaaaaaaaagatatgtagtactcctaacattcagcacctcagaacctgatcttagagacaggatcttcaggccaggtggcttcccttcctctccgcgtcagtctgtcccacctcagctcagcccaccggagacagagggtgcaggaacctggaggcggaggttgcaggaagccgagatcctgcaactgcactccagcctgggcgacacagcaagactccgtctcaaaaaaaaaaaaaaaaccttacaacaaaatgatgcagcccgggcgcagtggctcacgcctgtaatcccagcactttgggaggccgagtggggcggatcatttgaggtcaggagttcgagaccagcctggccaacatggtgaaatcctatctcaactaaaaaaaaaccaaaaactacagaaattagccaggcgtgatggcgcatgcctgcagtctcagctgcttgggaggctgaggcaggagaattgcttgaacccgggagtcggaggttgcagtgagccaagattgcgccgattgcactccagcctgagtgacaagagcaaaactccatctcaaaaaaaaaagaaaatgcaaagtcacctaagagacagtttaaatacataaaaagctcgatgccaaataaaactggatgggtcacttgataagtgggattgataaaaagcaagacagctgatattatataattcttatttgcttcgatatttactggggaaggtagaggggaaaagctatctaaattactcttaataagcatacaaatctctaatagtgaatcaaatgcatcattaaatatactaaattcctcaaactgatatgtcagatgtcaggtagtcatgaagacccaaaatagtctccatgggttttttgttgttgtttttttgagacagagtctcactctgttgcccaggctggagtgcagtggcaccatctcgactcactgcaacctctgtctcccgggttcaagccattctcccacctcagcctcccaagtagctgggattacaggcatgtgccaccacatttggctgatttttgtatttttagtagagacagggtttcactatgttacccaggctgttctcaaactcctgacctcaagtgattcacccaactcggcctcccaaagtgctgggatttcaggtgtgagccaccacgaccagccccttctctgtgttttaaaggcatttaagtataaattattaaactgcaggacagaacatattagctgacggtcatatgagtgaccttctctaaatgccaggaggatagaatccacttttcctttatcaatattttccttgctcaacttctgacatattaggtactcaataagtatgtgctgaaccaaaacgaacaaaaaaatgctgtcatcaaagtaacttccatctactcaagtaggctgcaacttcaaactgcccaaactagcaaatctctaataaagatgggctcagaagacatatcagcatgaataaccttctgaggaaaagacaacatggattctaaaagtggacatcacaccacaccagttcacccaaattctctgagaaaataaatatgtgtggctgggtgacggtggctcatgcctgtaatcccagcactttgggaggctgaggcgggtggatcatgaggtcaggagatcgagaccatcctagccaacatggtgaaaccccaactctactaaaaatacaaaaattagctgggtgtggtggtgagcacctgtagtcatagctactcgggaggctgaggcaggagaaacgcttgaacccgggaggcggaggttgtagtgagccgagatcgcaccactgcactccagcctgggcaacagagtgagactctgtctcaaaaaaaaaaaaaaaaaaaaaaaaaaaaaagacctgagtggccacaggatgagaacatttactgtagactggacataactgagacacagaaaattataggtagatgctgaggtacttccccaaatgaagaagtaaaaacagaagattgaaaatttttttagaaatgctatatttaacattttaatatattgtacaaaaaatatacagagaattccccattttgcagatgggatgatgagattcctaataatgaaataccacacgagttggaaaaataagggaacggagtgatggaaagggtttctaaatatattaaatgagaaacatttgcaaaaactaagatttatattcagcttagagaatgctttggcaagtataaaagctgtctaaatatgtgaagggttatctagcagaagacaaaccagacttgctctaagcagttcccgtgtagacaaaattgggcccaaagtggcaattccagaagggcacgcttcaactcaagctttctaaccatcagacctaactaaaaaggtggttcttaccttggattacctctaagagcccactgagatatgagtgttaaaaaattacatgcgaggaaatggcaggtatgttacagcatggacaaatgaaaagtaaggcatttacaggaaaaaaaatctaagctatacttaaaagactcatgccttcaagtcaaaaaaggaatttttgaataattatagaatattccctaaagacaatgtgatgttctatgcaaaaaaaaaaaaaaaaaaagggagggagggaggaccaaatcctattaggaaaaaactgtaaatcaagggtacccaatcgtttggcttccctgagccacactggaagaagagctgtcttgggccacacataaaatacactaaagtaacaatagctgatgagctaaaaaagaaaatcttaaaaaaaatctcataatgttttaagaaagtttacagatttgtgttgggccacattcaaagctgtcctgggccgcatgcagcctgtgggccatgggtcggacaagcttgctgtaaatagaacatattttcttatccttctaccaaatcacagtgtagttataactaaaatgcagttctgagtagttatcataaatccagaaagggaaagcaatgctgacaaagatcctggaaggaggtttcactggagattaaattaaaaagtcaagcatcttcagttgagaaacatgaaagcaaaggggcaatgtgatcaaaatcagaaaacgtatcaatatggtaaatactaatttattcaccttttatgcttgaaaagtatttctttatataacagataaaagaaacttgtggattgtgttaccacaatctacaagttaaaaatagattcaagtgctcggataaatgtaggtatattaggtccattcaggtcctacaggatagaagtgctatcagacgtgaggccctaaatttctgaggttaacatcttaacagataacaatgtttcacctgaaaacatcacttggtgccaatttagacagaacaattggttggacagaccccggacagacagactcaaggaggctggttggtatagacttccttccattcttttacctcagtatgtatgtgtgtgtaatatatacatacatattatactagaacatatatacattccttatctttatacacttagaatgctccttatatagctctgcaccctgaatttttcatttatcatttactcaacatcctaagacattaaaaattctttttttttttttagacagagacttgctctgtcaacaggctggagtgcagtggcaccatctcagctcactgcaacctccaactccctggtccaagcaattctcctgcctcagcctcctgagtagctgggatttcaggcacgtgccaccacgcccagctaatttttgtatttttagtagagatggggtttcaccatgttggccaggatggtctcgatctcctgacctcataatccgcccacctcggcctcctgaagtgctggaattacgggcatgagccaccgcacccggccagaaaaattctttcaaatactattccatggttgtaaatgtccatccttaaatataccatgatttattttcctataaatcttgctgctcatttaggtttattctcaattctcactaatatgaataatgttacaatgaacatctttgttcacaaatctttctatgtatcttaatttttcccctttaggataaattcctagatgtgcaattactgaattaaagaacgtttttaattttgccaatatatgttgccaaaatatctttcaaaaaaactaggcccaatgcacactccactagcagtttcagagattgtcccctcaccaccttcgacagcacagtcaactgtaaatctgataggttaaaaaaagagtatgtcatttaatctgcattcctttgattacttatcaggataaaaatgtttctcatatgcttcttggtcatttgtatttcttccttatgaactctgatcatgttctttgccagcaaaacttttctttctcttggccgacaaactttctgtggaaaaccagctgagatggaatcatttaaatatcagcaactgcagctccccctgctgacagataaattaccaccaccatcaagtgcccagtaaaaaaaagtgagctagaaccatacgcttgcctgtcttctgggctgctgctacaaatacaaattatacacggtaataaaaaagaaaatactgtgtatctaaactcatacttaacagagctgtgatggagaaggcaagggggacaagcgttttatttgttttttgttgttgttgttgttgttgttgttttttgagacggagtctcgctctgtggcccaggctggagagtagtggcgtgatctcagctcactgcaagctccgcctgctgggttcacaccattctcctgccacagcctcccgagtagctgggactacaggcacccaacaccacgcccggctaattttttttttttttttttttttagtagagacggggtttcaccatgttagccaggatggtcttgatctcctgacctcatgatgggcccgcctcggcctcccaaagtgctgggattacaggcgtgagccaccgtgcccggcccaaacgttttctaatgtgcaggaactaggcggggtgcagtggctcacacctgtaatcccagtactttgtggaggccgaggtgggtggatcacctgaggtcaggagttcaagaccagcctggccaacatggtgaaaccctgtctctactaaaaatataacaatcagccgggtgtggtggcacgtgcctgtagtccgagatactcaggaggctgaggaacgaggattgcttgaacccaggaggtggaggttgcagtgagccgagactgcgccactgcactccagcctgggcaacagagtgagactccatttaaaaaaaaaaaaactaatatgcaagaactaatgtcacaaacaattctaaaaatcaattccctgccaaatatactacctggcacatataaacatcacagacctaaatattcatttccctatactttaactatgtgaaaacactctaaattaccaaatgacactgggtggtcagcaaactagttctctttttccaaaagcaaaaacaacaaaaacacttttgccctttagcattcaaagaaagagtattaaaaatcttaattcttggcaatccttattccaaagttgcttgcacttatcagactgggaccaatagatccaaagagtaaggccaagactggcaaatgcatgtgactctcagcttttccactgataccctcctaaagatgcatgtcccaagtccagcaatacagtctttaacactcatttactaagtgccatcaagagcaagcagtgatggccgggtatggtggctcacgcctgtaatgccagcactttgggaggctgaggggggtggatcacctgaggtcaggagttcgcaaccagcctgaccaacatggtgacaccctgtctctactaaaaatacaaaaattagctgggcgtggtggcaggcacctgtaatcccagctatttgggaggctgaggcaggagaatcacttcaacctgggaggcagaggttgcagtgagccgagatcgcgccgttgcgctccagcctgggcaacaaagagcgaaattccgtctcaaaaaaaaaagaaacaaaaacagcaagcagtgaggataaaagacaagagcaagtcctcactctcaaagaacctagacactagctgggttcaaagtggagcaaactagcaatcagtacaatagaagtgctaggtctgcatatgcacactcacatgcacacacactaacagtttcagagattgtccccttaccacctttgacagcacagtcaactgcaaatctgataggtaaaaaatagtatgtcatttaatctgcattcctttgattatttatcagaataaaaatgtttctcatatgcttcttggtcatttgtatttctttatgaactctgatcataaagtgataatacctgggtccagaggaagcactcagtgtcagctactgttattactattatcactactgttattttgttttaaggctaatcaagtgaagcagtgggagtggagaaggaacaaagaaatctgtaactggctgtgatcaattaatagtaaacaccaatatacttggaccagccactactgttattaaagactagggggagtaagtttccagaacagggtagagtccatcttaagcagaggtaactgcttgtgtgaagacccagaggcaaagaacaacagggttcacagaaggaactgggcacaagctatctgtactactgcgtacaggatgctcaggaagaagtggagagatgatctggcaaaacatttcaactctaccttcaaagctagttgagccatggtggaagagggagggatatgatcatacgcttgaacatgcattttacaaggatcatgttggcagcgacttggaagagagaaagcagtcaaggagaatgattacaagacaacagaaggtcacgcagccaaaagggcgatgaaggtctggactcaaaaaggagaagtaggatgactaggaaaatattatgagctaggatctcaagaatgtggtgactagaatggcacaagaaggaacccagaggcctctcaaatccctgatttgagtgactggctgggtgacactaccgctcactaagatacgaagataggaagaggttggactggggaagtggataagatcattttaaaatgcccataagatggccagatgcagtggctcacgcctgtaatcccagcactttgggaggctgaggcaggtggatcacctgaggtcaggagttcaagcccagcctggccaacatggtgaaaccccatctctactaaaaatacaaaaactggccggacgtggtggcgcacacctgtaatcccagctacccggaggctgaggcaagagagtcgctggaacctgggaggcagaggctgccgtgagccgagaccgtgccactgcactccagcctgggggatagagcgagactccgtctcaatagtaataataataataaaaaaataaaataaaatgcccataggacatccaagtagagatgtccaggaagcaactgtgtatatgggattggagatcagaaaactagtcagagctggaaaaacacacatttgcaaatcatcggcatatagacggcaagtgaggcacaagtttatctaaggcattcctcataaactgcacagggtgagaggaagaagggtcaagggaaggcaaatactaatgtttttaggagcaaaagaggaaaaaagtctgcaaagaaaaccaagagtatgggccagacttggtgactcacacactttgggaggccgaggcaggtggatcacctgagatcaggagttcgagaccagcctggccaacatggtgaaacccatctctactaaaactacaaaaattagccagatgtggtggcgggcacctgtaatcccagctactggggaaactgaggcaggagaattgcttgaacccaggagacggaggttgcagtgagccgagatcacgccactgcactccagcctgggcaaaagagcaagactccgtctcaaaaaaaaaaaaaaaaaagtttcaaagataaaacaaaaatcttgttaaagataaatacatgagaagctaaataaataatctacttctttaagtcatgctatcaatttgcaccaaaattttcatttcctatgtgtaggtgtcgagggtctagtacccatgataaatgatatacacctgttctgggctgaattgtgttccccaaaagagatatgtagtactccaggggcctgggcacagtggcgcattcctgtaatcctagcactttgggaggccaaggccacaggatcgcttgagctcaggagttcaatatcagcctgggcaacatggcaagaccccatctctactaaaaatatttaaaaatagccagatgtggtagtgtgcacctgtagtcccagctactcaggaagctgaggtgggaggattacttgagtccaggggttagggggctggaggttgcagtgatccaagtgccactgcactccagcctgaatgacaaagggagaccctgtctcaaaaaaaaaaaaaaaaaaaaagagatatgtagtactcctaacattcagtacctcagaatgtgatcttagagacgggatcttcagaccaggtgcagtggctcacgcctgcaatctcagcactttaagaggccgaggtgggtggaccacttgaggtcaggagttcgagaccagcctggccaatgtggtgaaaccccatctctaccaaaaatgtaaaaattagctaggcacggtggcgagcacctgtaactccagctacttggaaggctaaggcagaagaatcacttgaacctaggaggaggaggttgcagtaagctgagatcaccccactgtactccagcctgggcaacaaagagagactctaaaaaaaaaaaaagagataggatcttcaaagaggtcataaagttaaaatgaggtcatcagagaggactctaatcccaatatgacttgtccttataaaaaaggggaaattgtggacacaaagaaatacacacagggaggctgggcgccgtggctcacgcctgtaatcccagcactttgggaggctgaggtgggcagatcacttaaggtcaggagtttgagaccagcctgggcaacaaggtgcagccctgtctctacaaaaaatacaaaatttaggctgggtgctgtggctcatgcctgtaatcccagcactttgggaggccaaggcaggcagatcacctgaggtcaggagttcaagaccggcctgggcaacatggtgaaaccctgtttctacaaaaaatacaaaaaattacctgggcatggtgacacgtgactgtaatcccagctacttaggaggctaaggaaggagaatcacctgaacctgagaggcagaggttgcagtgaaccgatattatgccactgcactccagcctgggcaacagagcaagactctgtctaaaaaaacaaaagaaatacacacagggagaactctacataaggactggagttatgctgccaccagaagctagaagagaggcttgaaacagatcctgtcccagttgcttcagagaaagcatgcctctgcccttagatttctagcctccagaacagggagacaataaatttctgttatttaagccactcagcatatgtcactctgtggcagcagccttagcaaacagatgtcataagaaaattcgcagctcaggtttactaagtacctaccaggtgctgttctaaacactctgcgtgaataaactcatttaatccttataaagtccactctaggatctaggtactatcattataccctttttacagtgtggacaccaaggttctaagaggttaatgagcttacccagtatcacatagccagagccctctctctcaccactagtgtatgaggagctattattaacagtaattacaataagagctggcgtggtggctcacgcctgtaatcccagcactttgggaggccaaggcgggtggatcacttgaggccaggagtttgagaccagcctggccaacatagtgaaaccccgtctctactaaaaatagaaaaataagccgggcatgctggcatgcgcctgtaatcccagctacttgagaggctgaggcaggagaattgcttgaactcaggagacacaggttgcagtgagccgagatcgtgccactgaactccagcctgggcgacacagcaagactccatctcaaaaaaaaaaaaaattagtaattacaataagaacagtagtagtccactgaaccaaacactgccctatgtcctttacagatataatacaaaagtcctctgaagtaagtgttattatttccagtatgaaggaggaacctgaatctcagagagattaagaaaatcgcccaaagtcacacggttaagagtgctgagattaggccgggcacggtggctcatgcctgtaatcccagcactttgggaggccgaggcgggtggatcacctgaggtcaggagtttaagaccagcctggccaagctggtgaaaccccatctctactaaaaataaaaaaaaaattagctggccatggtgacaggtgcctgtaatcccagctacttgggaggctgaggcaggagaatcacttgaacccaggaagtggaggttgcagtgagccaagatcacctggacaacaaagcgagactcttgtctcataaaaaaaaaaaaaggaagaagaatgctgagattatatctaattgctaacttaaggggatatacaatgaaaacctgtttttactaaaactttaagaacaagttaattttttttttttctttaatgagacaagagacaaggtctggctctatcacccaggctggactgcaggggcgcaatcacagttcactgcaacctccacctcccaggctcgagccatcctcccacctaggcctctcaagtagctgcaactacaggtgcacaccaccatgcctggctaattttcttttgtatttttagtagagatggggttttgccatgttgcccaggctgttctcaaactcgtgtgctccagcgatctgcctgttcagcctcctaaagtgctaggattacaggcgtgagccatcgcgtctggccaagttaaattttttaatgcctgactttgcagttcaatactagaaatatacatctataaattcaaaattcttgaagatcccaagagaacacatgtcctagattatgggcccttttgcgtgtgtatcccctcaaccactgttcaagaactattctctcggctgggcacggtggcccacgcctgtaatcccagcactttgggaggccgagttgggcggatcatgaggtcaggagatcgagaccatcctggctaacacggtgaaactccgtctctactaaaaatacaaaaaattagccgggcgtggtggcgggcgcctgtggtcccagctactcgggaggctgaggcaggagaatgacatgaacccaggaggcacagtttgcagtgagccgagattgcgccactgcactctagcctaggtgacagagtgaggctccgtctcaaaaaaacaaaaacaaaaacaaaaaaactattctctcagttagaacccttgccatttctctgacttccagacacagaaagagaagaaaaggaaggattgagatgctgttctttaaaatttttttttttttttgagacggagtctccctctgtcgcccagactggagtgcagtggcacgatctcggctcactgtaaactccgcctcccgggttcacgccattctcctgcctcagcctcccaagtagctgcaactacaggcgcctgccaccacgcccagctatttttttgtatttttagtagagacggggtttcaccgtgttagccaggatggtctcgatctcctgacctcatgatccgcccgcctcggcctcccaaagtgctgggattacaggcgtgagccactgcgcccagctaaaattttcaattttctatttaatttttaaaatctgatacaaacatcagaaagtgtaaaaagatataatgcaatgagaagtctccttcctactctgtcctctacctgaacaattcctagacctaacaggtaaccagtgccaccattttcttatttattcttctaaaggtttgtgttgttgctgttgtttgagacagagtctcgcttggtcagccaggctggaggacagcggcgtgatctcagctcactgcaagctccgtctcccgggctcaagcaattctcctgcctcagcctcccaagtagctgggattacaggtgtgtgccaccatgccccagctagtttttatattttcagtagagacggggtttcaccatattggccaggctggtctcagactcctgacctcaggtaatccacccaccttggactcccaaagtgctgggattacacgtgtgagccaccatgcccagccctaaagatcttttttttttttttttgcatacatacaccaatgcaaattatctttttctcctgtttttttttttccaaaaaacacaaagggtatcaaatcatacatactgttctgcatcttgctttcatcacttaactgtctgccttgcagatctttctatatcatattaaattatgttttaattctctcgttttgcttgtcaagaacagtttttacttcatttcaccatagttcagtctagcacacaaggcatccagcagccctaagaactacctgaaacaactgatgatggctccatgctacacactaaagaccctgtatcttttctctcctcctcatcttcatttcactcttttctccgactcactcaattctccttcctttccctattcctctcccatctcacccactccttagccctaaccctgacaactagaccctagtaacatcactgacattgcttagtcgtggctagaaatattcaggctttaaaaaggtacagacccctaacacagagaaaaagggataaataataatttccatgagaacttctaattaacgagagtgccttaaattgaggagttttggcttggagttattcttccttgttacttgcctcctctggcattttcatttgtgaagactgagtgagtgtgacgctattttctatacgcatggaaacaagcacatactcagtctaacatttacgcaatgcctgacagaacgacagagttcattctacaataagataattggaaacaaaatataagatctatataaaataaacatttgggctccaaaatatgcactttaattaacctatcatttctttttacttaaattaagtagctccaatctgaaactacatcttagaaatgttttaaggatattcaccaatgaaaaagagaataaagttccctctccccacttttattttccagcccacaaactcaatgctatcctccccgcaaaaaggacctttttttctgaccagacgaacactgtaatttttaaggtttctaagtaataaaaataggaagaaaacattaccccccaaaattggtttacacttagaagatgtttcccactgagcaaaggattggtaaggaacataatattaaggcaaccacctaactgcattcttaagtagtaacaggtggtaactcacgatatggagctgatttcctttctctattcctgccatgccagagacctctagtagaacttctgaggttactgtattacaacccaggttcagagagatttagaggtaaaaccttaaacactggaaatatctttaaaagtagggctttgtgtaccaaatacattcgttaaaacctaggaaactataaaatgaaatccaatgtattgatctcaatccccttgcctgcttcctaaagaggacagaggccaccaacactggtgctcaacacttgctaagtcgaaacactcttacacaggtcctctgattcttaacgggttcagaacttctggttgcattccccatgcaacccctccaactctacagggagaatgctggaaaaactgtgtcactttggcttcctgtatattaatataagcactcttatccagcaatagcagctgaaacataaatgaagatgagaactcagcctacatgacctaagatttcccacaagtccagatatttaggttacacacactgcactattgtctgatttctcctctgcatcaatctggaagtccacagagcagattagcacccaacaatcttaactaagctagtatcctactctgaagaaaggcgaagctggtggagggtttccaagactccttatccttctctgtccttcctcccatcccctccttacgtcttttctgtttgtttttatttaattttttttttaatgtatttttagtcacaagaaaatcaaagaagccacctacttaagtcttaagctctgccctttgcttagtcctaatggagagttctttggccatctatgtacaagagattagaggagccaaagagactggagaaccacatcaatgggagctttttcatctaaaggtcatctgtccacactgtccaaatgaggtttaccctgtgaaataaaacttggtgtaagtgctacctgctgagaaaaatagtatgaaatgtcacacaaaggactggggtgcagcaggaggactctgaaagagtcatacgtgtaaaccagcaggtcttagaatgccctaatatactatatgaagtttcagagtaaacaaatggttaatgacacatcttttgtaacacatgaatcagctactgatttgcaagagtgggacacaccctagtacctatgactctaaagtacctgtttgaaaagtggacctagatgtttgaattgccaacccatcctaagaccggaacataattttacaactatgtaagttgccataatttaaagttaaaaagatcactgcctttcattataatggaagttaatttgagaacttcattaaaacattcacaccgataatcaaagaacagtagagatacaaagtaaaatatagccaatcaatcctaggaagcaaacacaagaggcaagagaaatggcaggtaaaggaagtgaagaatagcaaattcaaaaactacaatattcccaattctaaagaaaaatgaataaaatgaggctggtaatgaaaaaataacacatcttaccttaagaggcatccaagtagcattcatagtgtcaggatataaagacaatactcagaaatgagcaagaagtcttagtaattccctcggttaccaagtataagcaggtaggaaaatcttttgtttcgagaaggtatctgaaagagaggattttcatttagactaaaaaataatcaagacaatgcaaatagtttaagctacctgggcagggattttgaagtactatttgcctcatcgcactaaaaaagtatagaaaatacagtcccctttagaaaagggcaaatgtgtgtctccatatatatgtgtgtagaaacatactttacataaaaagagaaataaatatgtaacacgtattttagataatgtaaaattgcttatcaaacaattagccaaaatcccagagagaataaagtaattttccagggtacttcataaacactaaacgtgatttgttaactaaccgtctaaagaaagacccttgccacatttaattatatttagtaaagtaaaacttctctaatcatcccgactgtcccaagattatgcttaagtttcagagtcaattccacatgaaaagtaaaacctattcttgactgaagtactagaaacaaataaaagacccttcttccccagagatcgttaaaagcagaccgagcaacttaattttgagggtgggaggaaggtaaatttgcctggaggcaggaggatggactaaatgacctctggtaggatcctcgttcaagtcctgggcctgtatacaattccagcttaaccagttactgcttcgcttaaaatggaggcttgcctgcgtagggacaaaaataacagcacccacttcttaaaaataaatgtcgaaaagtacccctttttaaataaaaataaaaaataaacacctctggagtggatgtgttcttgctatgcgtttgtcactgaggcttcgaagacttggcatcactttccttaccgctcaccggattttgggggaggagcggggggcgacagtttgactcttgacccaagtctcaggcggacttcagagccccacaggggcccccaactccagagccagagggagcggagaggcgagagcccgagatcgcacctccccccaccgcggaccccagtcccaaacccacccctcacctccccgcagtggggcgcctccttctgccccattcccattgttagggagggcagagcgcggggtgggctcagggcaggggcgcccgcggccgttgcccggctcgcttcaggaggggcgccccgcgggatgcggcttcccttcctctccgcgtcggtccgtcccacctcggctcggcctggcgccccgaggtccgctccgcgcccccggccgcggccccggcccgccccccgggcagccaggccctcaggccagtcggccggcagccggcgtcccaggcctacgagtgggcgctgggcgggggtccccgtgccccacacacgcgtcccctctcccccagccccgccgcttccagggccctcggcggcgcccgctccccgggccccgcggccccccgcctcccagccgggccgctccctcgagctcgtcgggtcagggacacctcctctacctcaccatcaccctggcccactcgtgcccccacccccaggggcaccagtgccaaaggcagctcccccagccccggacctacctgcacggttcaaccaagcctagaagtgggggcggggaatcttccgccctcctctggcgcccattggcccttcaggggcacatcgtgagcgccattggctgagcaatggtgtccgtcagagcgatggggcgggacagaagggggagagggatgctggtgccttggcgtctctgtctctgtgtatctcgttgtctctgtctctgtctcggcccttggaaacgagaggcttttggctgagaggactagaagggggcctgaggtgggaggaataggaataggaatcctgacagagcgtcacgccagttggccactctgaacgccctacctaagtcccctttaggttctcttctccatcacccccaacccctgcccctcacccctcgaggttctttcatccaggaagcgacgtgatgaaaactccaggccggaaggccatagggagagatgttatatatgtatataaaatatacacataaaaatgtttatatataaactcaaccagatatcagttcactagggcctggaaaggaaagggcacacatctcacagacagggaaggacttgagatagagccggtagaagaaggaatcaaaaatcactctaagagctggcaacagtggttacctcctgggagaggaactgagtgcctagggaaccagtgggcggaagacttacatatctcggcatatcatttgtatccattgatttttgcaccattcatcaagattccaatttaaagaaaaggatttaaatgtttaaataaggtcgcaaaaccaggggacagacaagataattgggcaggaaaattggcgcaacatgcagatttggggaggaatcttagcttttaatatgttcagctcccggtaacagggttttgtaaaacccagtgaaggtgtcccagaggcaactgaagttatggaacttgagagagggtagacaatcaggactagagaagatgcagggtcctctgcctaaagatagtgatctatgacatgctaaaggataaactcccaaagaagggtaataagacacccacagtaaaaggtaggaggacgaaaaagaaggtcagtgaggtaaaagaaacaatattaaagaggcatgaaaattaagggaggaagggtctgtggaaaatagaataataaaactatgagagaggccgggcacggtggctcacacctgtaatcccagcactttgggaggccaaggcgggtggatcacctgaggtcaggagttcgagaccagcctgcgcagcatggtgaaacccgatctctaatagaaatgcaaaaaaaaaattagccaagcgtggtggcgcgcctctgtaatcccagctactggaaaggctgaggtgggagaattgcttgaaccgggaggcggaggctgcagtgagccaagatcgcgccactgcactccagcctgggcgacacagtgagaccctgtttcaaaaaaaaaaaaaaaaaaaaaaaaacaacaaacaaactgtgagagcctcataggtcttacctctttacctctttaggctctggtaaccatgggacaataagaatgaaagccaaggccgggcacggtggctcacgcctgtaatcccagcattttgggaggccaaggtgggcggatcacaaggtcaggagatcaagaccatcctggccaacatggtgaaaccacgggcatggtggcgcatgcctgtaatcccagctactcgggaggctgaggcaggagaattgcttgaaccagggagtcagaggttccagtgagccgatatcacgccactgcactccagcctggatgacagagtgagactccgactcaaaaaaaaaaaaaaaaaaaaaaaaaacaacacctttatcgattaagaatcttttttctgagtttattaattctatttaaatcaaccccagaaaacaccttcaacacagcctctcatttcatatctgtaaaatggggcaaaaaaaaaaatagttcctaccctttagagttgttgtgaagattaaattagtgaatacatatgatggatttttttttcttttttcttttttatgagacacagtctcgctctgtctcccaggctggagtgcagtggcactatctcagctcactgcaagctccgccttccgggttcacgccattctcctgcctcagcctcctgagtagctgggactacaggcgtccgccagcatgcccgactaattttttgttatttttagtagatacggggtttcaccgtgttagccaggatggtctcaatctcctgacctcgtgatccgcccgacttggcctcccaagtgctgggattacaggcatgagccatggcgcccggcctgtgtgatggattttttaagagcctgactggcggggtgaggtggctcatgactgtaatcgcagcactttgagaggctgaggcaggtgaatcacttgaagccaggagttcgagaccagcctgggcaacatggcgagacctcgtctctacaaaaacacacacacaaaaattagctgggtatgatggtgcatgcctgtagtcccagctactcaggagactgaggtgagggtcgcttgagcctgggaggcagaggttgcagtcagccgagatctcaccactgcatttcagcctgggtgacagtgtaagaacctgtcaaaacaacaacaacaaaaaaaacaaaacaacaacaacaaaaaaacgcacgaaaaaaaccacataagctccttgagggcagaaactgtcccctagtcttctatattttatttcacacaatgtacagaagactaaatgaataattgttagctggtttttttttttaaaggggataagatcagttacaatgtctttttcctcagtcaatcacataagtatctaaaatgacattccaaagtaaggacaggagtttaaatcctgaactatggtatctaaagtaaacttgaactttccttatttttaaaaaattttggccgggcgcggtggctcacgcctgtaatcccagcactttgggaagctgaggcgggcagatcacaaggtcaagagatctagaccatccttgccaacatggtgaaaccccatctccactaaaaatacaaaaattagctgggcgtggtggcacggacctgtagtcctagctacttgggaggctgaggcaggagaaccgcttgaacccgggaggaggagactgcagtgagccgagatcacgccactgcactccagactggcgacagactgtctcaaaaaaaaaaaaaaaagaaaaagaaaaaagaaaagaaaaaaattccatacatagaattctgtgtggcattttagagaaaatcatggtgactagagacaccaggtgaaatttttttttttttttttttggtgacacaaccccaggagatcctgtgaacatgtgtcccttgaccaggtgaatttcaggagcttgcactagtcccaggttagctggcaccaggttggccctagtttgagtgccttccacataccaggtactgtgctggagaagtaacatcaaaaaggaaaatcaaatttcatcttcaataagcaatcacaatacactgtgatgagagttagggtgaaggaggttcaggttaccatgggcttatattaggagggcaaattctgtcttcaagtctttttgcttcaacagtagcgtttagatcttgtgggctgggcatggtggctctagcctgaaatcccagcactttgggagggtgaagtgggcagactgcttgagcccaggagttgcagattagcctggcaacatggcgaaaccccgtctctacaaaaaatacaaaagtcagccaggcatagtggtgcctgcctgtagtttcagctacttgggaggctgaggtaggaggatcgcttgaccccaggagttcaaggctgcagtgagctaccatcgagccacttcacttcagcctgggccgcagaataagaccctgtctgaaaaaaaaaatcttgtgatataataacagcttgtgcactcttcgatagctcagctggtagagcagagggctgtagactgcatagataataataacagtttgcgtttttgagtcaaagatgataccccagaatcattatcgaaaataatggttgatccattcacctgtgcctatgactgtgagccacattgtgaccaatctgtgagcaacatgggtgggaatgcagtttggggccatggaactcacttaacaggaagttccaatagcagtggatttaccatgttgcggctgtaggatcttggacaaatatttaatgacctctgtctctcagttctctcaataataaaacatccctccgagagttgctgtaaaggttaacatagggggagtcttgcaaatagtaggtgctaaaatcctgtcttgaaaaaaaaaaaaaaatatatatatatatatatatatatatatatatatgaagagatgagatcttcaattgtacagactgtccctgtacccattcatttgcatttcttttcctttacaataatacatatctatgatttcctttcattcccactgtcatcaatttagttagattactgggcagagatcaccagtggggctagagtaaaatgaaaataaatgtacattgactctaggtattcctaagtaatagcacagtttactgtgttctccctcataaatcctggtagctgaatgttgcctgcttttagcagttacgtttctgctcatctcaccctcaatgttcattaagaaaatagttattgaatggccaggctcactggctcacgcctgtaatctattacaggcgtgagccaccgtacccagccttggttatcatatttctaatttataatagtttttcttgttttcttattgttcattttttatagcatcctgttcttatattatggatatatatcttcaggtctcgctgaagaaataaagaggtgtatgtgtatatatgtgtgtgtgtattatctttatttttattttttgagatggaatcttactctgtcgcccaggctgtagtgcagtggcgcttttgggaggctgaggtggaaggatcacttaaggccaatatttggagaccagccagggcaacataacaagacccccatctctacaaaaaaattaaaaattagctggccatggtggtgagtgcctgtagtctcagctacttgggaggctgaggcaggaggattgcttgagcccaggaggttgaggggggaggtgagccatgattgagccactgcactccagcctaggtgacagagtgagaccccatctctaaaaaaaaagagagagagaaataaaatagttattgagcacctactgtatgtcaggtccaagaccctaaagatgtaaagatgaataaggtggtgaccctgccttccagtttccacaaaggtggggaatatggataaaagcagacaaagccattgccatgggataagggcagagaatagcatgtgcaaattatagaaggtgagggataatataccactttccagaaactgatggttcaatgaggctaaagcatggagttcaagaaaggaaaccagatgagattaactgcaatgtggttctcaaacttaaatgtgcataaaaactggccttgttgactgggcacagtgactcacaccggtaatccaagcactttgggaggtcgaggcgggcggatcgcttgaggtcaggagttcgaaactagcctggccaatgtggtgaaaccccatttctttttttttctttttcttttttttttttttttttttttgagacagagtctcgctgtcgtccaggctggagtgcagtggcgtgatctcggctcaccgcaagctccgcctcctgggttcacgccattctcctacctcagcctcccgagtagctgggactacaggcacccgctaccatgcccggctaatttttttgtatttttagtagagacggggtttcaccatgttagccaggatggtctcgatctcctgacctcgtgatccgtccgccttggcctcccaaagtgctgggattacaggcgtgagccaccgcgcccggcctgaaaccccatttctactaaaaatgcaaaaattagctgggtgtggtggtgcacacctatagtcccagctgctcaggaggttgaggcgggagaatcacttcaacctgggaggtggagatggagtaagccaagatcaagccactgcactccagcctgagtgacacagcgagactctgtctccaaaaaacaaacaaacgaacaaaaaactggccttgtttacatagtctcgcaagctccaagcctagagatcttgatggagcgggtcagagtgctgctgctcggagggctacactctgagaaccaccgatggagaagaagggcggggtcaacttgcagagctgtgctgggaggtgtgtgctgcagccttgagggggtgaagaacctttgagaggttttaagcctgcaagagatgtggtcacatttatattttagaaaaatcaccctgtgtgcaatatgaaaaatgaaacagagagggcaagactggagtcagggagagcagttaggaggctgctgcagaaacccaggcaagaaatcataaagacctgaaataaaacaatgccagtggggaacggggaagagaggccaaatccaaggggtatttaggagccagaattgagagggtgtgatgagtgttgatgggatacaggacaggatcctgagatggcttgcaggtcttcagctttgagtgacccatggaagcgaaggaagatgggaaggagggtgcctatcacacagagagaatgaaggtttgagaggcaagtgtagcttttgacattttgcttttgaaatgtctatgggacatcagaaataatctcaaaagaccacaagtcaggcagggcgcggtggctcacgcttgtaattccagcactttgggaggccgaggtgggcagatcacgaagtcaggagctcaagaccagcctggccaacatggtgaaaccccgtctctactaaaaattcaaaaattagctgggcatggtggcgggcacctgtaatcccagctacttgggaggctgaggcaggagaatcacttgaacctgggaggcggaggttgcaatgagctgggatcgagccatcgcactccagcctgggcaacaagagtaaaactctgcctaaaaaaaaaaaaaaaccatgagtcactggttaacagcctgagcggcagaaatctcacagttctgagtctgaatcctatctagcctggctctgaaactcacaatctggagctggggcttggtgcagtggctcaggcctgtaatcccagcactgtgggaggctgaggcaggtggattgcttgaggccaggagtttgagagcagcctggccaacatggtgaaaccccatctctactaaaaatacagttagccaggcatgatggtgtgcacctgtaatcccagctacttgggaggctgaggcacgacaatcgctggagcccaggaggcagacgttgcagtgagccgagattgtgctactgcactccagcctgggcaacacagcaacactgtctaaaaaaaaaaaaaaaaatgctgggcgcggtggtttacgtctgtaatcccacttttagaggctgaggtgggaggatcacctgaagccaggagctcaagaccagcctggccaacatggtaaaacccgccatcccctccctgccatgccccatctcccccaacactctcccaccctgtctctactaaaaatacaaaaattagccgggtgtggtggcacacacctataatctcagctacatgggaggctgaggcataagaattgcttgagcccggaaggtggaggttgcagtgagccaagatcgcaccactgcactccagcctgggtgacagagcaagactctctcttaaaaaaaaaaaaaaaaagaattttttttttaaatatagagatgggctttctgtgtttcccaggctatactcaagctcctgggctcaagctattctcctgcctctgccttcaaccagcctcaatcctccaattttcttattttttatatttttcaacaccttttaaattctacattctggccagctgcagtggctcatgcctataatccagcactttgagaggttgagatatgagacttgcttgaggccaggagtttgaggcttgcagtaagctagaatggcgccacggcacagcagcttgggagacagagcaagaccttgtctcaaaagaaaaagaatttaaatactacattctaggagatttcttcaaccttcaaattttgtattgaatttttaattttggcttttatttatttattttttttttgagacaggttctcactctgtcacccaggttggaatgcggtggcttgatctcagctcactgcaacctctgcctcctgggttcaagtgattctcctgcctcagcctcctgagtagctgggattgcaggcgtggtccagcatgcccagcttatttttgtattttcagtagagacggggtttcaccatattggccaggttggtctcaaactcctggcctcaagtgatccacatgcctcagcctcccaaggtgctgagattacaggtgtgagccactgcacccagccttggctatcatatttctaatttatgatagtttttcttgctttcttattgttcattttttatagcatcctgttcttatgttatggatatatatcttcaggtctcgctgaagaaataaagaggtgtatgtgtatatgtgtgtgtgtattatttttatttttattttttgagacggagtctcactctgttgcccaggctggagtgcagtggcacaatcccagctggctgcaacctctgcttcccaggttcaactgatcctcccacctcaatctcccaagtagctgggattacaggcacctgtcaccatgcccggctaatttttctttctttgtttcttttttttttttttttttttttttttgagatagagtctctgttgcccaggacggagtgcagtggtgtgatctcggctcactgcaagctccacctcctgggttcaagagattctcctgcctcagcctcccaagtagctgggattacaagcgtgtgccaccacacccagctaatttttgtatttttagtagagatggggtttcaccatgttgtccaggctgatctcaaactcctgacctcaaatgatccaccttcttcagcccgccaaagtgctgggattacatgcatgagccaccacaccagcaaaatttttgtatttttagtagagatagggtttcgccatatgtgtgtgtgttttaagtttttctgttttcatttctcttggcatatatacctcggaatggaattactgggtcatatgggagctctgtgttaaacacttgtgtcatatctaagaaaacttgctaatccaaaggtcataaagatgtatgtctatgttttcctctaaggccaacatggtgaaacactgtctctattaaaaaaataaaaactgggccgggcatggttgctcatgcctgtaatcccagcactttgggaggccaaggtgggtggatcacctgtggtcgggagttcgaggccagcctgatcaacatgcagaaaccccgtctctactaaaaatacaaaaaaattagcagggcatggtggcgcatgcctgtaatctcagctacttgggagctgaggcaggagaatcgcttgaacgcaggaggcagaggttgcggtgagccaagatcgtgccattgcactccagcctgggcaacaagagcaaaactcggtctcaaaaaaaaaaaaaaaaattagttgggcgtggtggcgcgcacctgtagtcccagctactccagaggctgaggcaggagaatggcttgaacccaggaggtggaggttgcagtgagctgagatcatgccactgcactccagcctggcaacagagcaacagagcaagactccatctaaaaacaaaaaaaagagttttctacttttcagtctaacaaatgttttataaacaaaggctttgttatattttgagttaatttttatagataatatgaggtgaggtttcaacttcattctattgtgtgtgggtatccagttgtcccaggaccattgtttgaaaagacttttttttctacactttctctcattgaattgtcttggcatatttgttaaaaatcagttgaccttggctgggcaccatggttcacacctgtaatcccagtattttgggaggccaaggcaagaagaccatttgagcccagaagttcaaaacccgcctgggcaatataggcacactccatttctaaaaataattattaaaaagattagctgggcaggccagacatggtggctcacgcctgtaatcccagcactttgggaggccaatgcaggtggatcacctgaggtcagaagttcaagaccagcctgaccaacatggagaaaccccatttctgctaaaaatacaaaattagtctggagtggtgactcatgcctgtaaatcccagctactagggaggctgaggcagaagaattgcttgaacccagaaggcggaggttgtggtgagccgagattgcgccattgcactccagcctgggcaacaagaatgaaactctgtctcaaaaaaaaaaagattagctgggcgtggtggcacatgcctgtggtcccagtgacttaggaggctgaggcagggggatcgggagacggaggctgcagtgagccttgatcactgcactccagcctgggtgacagagtgagaccctgtctcaaaaaagaaaaaaaatcagttgaccgtaatgtgagcactcatttctggactttcaattctattccattgatctatatgtcagtccttatgccagtgcccaggggctcaactactggtactgtgaattagattttgaatcaagaagcgtgagtcttccaattttgttcttatttttcaagattgttttgtctatttgaagttccttacaatttaatgtgaattttagaatcagcttgtccatttttgcaaaaaaggtagttgggattttgatagagattgtgttgagtctgtagatcaatttgggaggcattgctatgtgaagagtagtaagtgtttcaatccatgaacacacaatgtcttttcatgtatttaagtttaatttctttcaataatgttttgtagtttgcacttccttggttaaattcattcctaagttttttttggtgccattacaaatggaattgttttattaatttcatttttggattgttcatttctagtgtatagaaattcaactgagccaggtgtagtggtgcaccacctgtagtcccagctacttgggaggctgagtcaggaggattgcttgtggccatgtttgaggctatagtgcattataattgtgcctgtaaatgatcactgcattctagcctcggcaacatagtgcagtcttgtctcttaaaaaataaataaataaacaactgatttttgtacgttgatcttgtatcctccaactttgcaaaattaatttattactattaagactttgtggctgggcacggtggctcatgcctgtaatcccagcactttgggaggccaaggcgggcagatcacgaggtcaggagatcgagaccatcctggccaacacggtgaaaccccgtctctactaaaaatacaaaaaattagccaggcgcggtggcaggcacctgtagtcccagctacttgggaggctgaggcaggagaatggtgtgaacccgggtggcagagcttgcagtgagccaagatagcgccactgcagtccagcctgggcaaaagagtgagactccgtctcaaaaaaaaaaaaaaaaaaaagattttgctttattttgtgtttggtgtggatactttaggaaccaaaagataaataaataagaacaaggtctagcactttggtcaaatttattcctaagtgtgtgtttgtaaacgatattgtaaatgaattttcttagtttcattttcagcttgctaattgttactgtatagaaatacaatttatttatttatttactttttttttttttttttgagacagtctcgctctgttacccaggctggagtgcagtggtgtgatctcggctcactgcaacctctgcctcctgggttcaagcaattctcttgcctcagtctcccgaacagctgtgattacaggtgcgtgccgcaacccccagctaatttttgtatttttagtagagatgggttttcaccatgttggtcaggttagtctcaagatgttcttttttttttttttttttatcattttatttatttattttttaatttttatttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcctgcctttctattccacaaagccgccattgtcatcctggcccattctcaatgagctgttgggcacacctcccagacggggtggtggccgggcagaggggctcctcacttcccagtaggggcggccgggcagaggcgcccctcacctcccggacggggcggctggccgggcgggggggctgaccccccccccaccggtcaggttagtctcgaactcctgacctcatgatctgctcacctaggcctcccaaagtgctgggattataggcatgagccactgcgccaggccaattttttttatatcactcttacacctgcaactttgctgaatttgtttacttgttctgacggttttgtggattccttagaatttcctacatacaagatcatgtcatatgcaaatacatatggttttatttcttcctttctaatttgtgtggcttttatttctttttcttgctaatttcctggctagaaatttaagtataatgttgaatagaggtggcaagagtgaatatccttgtcttcttcctgatcttaggagaaaaacttatagtctttcatcattaagtattacctgtggggctggatgcgatggctcaagcctataatcacagcactttgggaggccaaggcgggtggatcatttgaggtcaggtgttcaagaccagcctggccaagatggtgaaacccccatctctactaaaaacatctctactaaaaatataaaaacttggcggggtgcagtggctcacacctgtaatctcaccactttaggaggccgaggcgggcagatcacgaggtcaggagatcaagaccatcccggctaacacagtgaaacccatctctactaaaaatacaaaaaaaaaaaaaagaaaattagctaggtgtcgtggcacacgcctgtagtcccagctacttgggaggctgaggcaggagaatcgcttgaacccgggagacagaggttgcagtgagccgagatcacaccactgcgctccagcctgggcgacagagcaagactccatctcaaaaaaaaaaataaacgtaaattagacaggcatggtggtgcgcacctgtagtcctagctactcaggaggctgaggaaggagaattgcttgaacctgggaggcagaggttgcagtgagtcgagagcatgccactgcactccagccagggtgacagagtaagactctgtctcaaaaaaaaaaaaaaggatttatgggaagtaattaaggtcaaatgaggtcataaagctgggcactgatctaatagaattagtgtctttatgagacgagaacccagagagctccctagctttctctctgccacatgaggccacttcaagaaggcaagccaggtaataaagcccacgctgaggtaggaggtggaactggactccagagatggggcttggacaccagaccaaattgatgactagctgaaacagggacagggtgaaagcagctttccataagacacgctcaaccagtgcaccatgtcagcttaccatttccatggcagaacccagagttaccaccccaccgccttttttttgagacggagtctcactctgtcgcccaggctggagtgcagtggcacagtcttggctcactgcaagctccacctcccgggttcaagcgattctcctgccttagcctcccgagtagctgggattacaggcgcctgccaccgcgccaaactgatttttgtatttttagtagagacagtgtttcaccatcttggccaggctggtcttgaacttttgacctcatgatccacctgccttggcctcccaaagtgctggaattacaggcctgagccactgtgctcagcctaccacccctttcaatggcaacaacttgacaacccagaagttatcagcctttttctagaaacgtctgtatagtctgccccttaatttgcatgtaattaaaggtcaatgtaaatatgactgcagaactgccctgagctgctactctggtcacactacctacagggtagccctgctctgcaaggagcagtccctctgctgttgctataggccactgcttcaataaaagttggcatctaggccaggtgcagtgggtaatgcctgtaatcccagcactctaggaggctgaggcgggtggatcatttgaggccaggagtttgagaccagcctggtcaacatggtgaaaccccatctctactaaaaatacaaaaaaattagttgggtgttttggcgcacacctgcactcccagctactcaggaggttgaggcgggagaatcacttgaacccaggaggcagagtctgcagtgagccactgcactccagcctgggtgacagagtgagaccctgtcccgaaaaaaaaaaaagttggcctctaacaccttcggtttgcccttgaattatttcctgggtgaagccaagaaccctctcagtctaagccccagttttgtggcttacctgccctgcatcaacaccagaaacttaaccctttgggaatctcgatcttggactttctagcctctagaaccatgagaaaatgatctgtattattaggctacccagtctatgatattctgttgtagcctggggtgactaagacattgagcctgtatgacttgaattttgttacctgcttggccccttgatggcatttcagtttgtgactcttggtttacgtgatcacgaagccaaaactgtttaggaaggaagcaaaatcaagacagattaaaaataaaaataaaaaataaaaggctgggcaccgtggctcacgccctcccagcacgttgggaggcaaaggtaggcagataacttgaggtcagcagttcaagaccagcctggccaacatgatgaaaccacatctctactaaaactacaaaaattagccaggcgtggtggtgggcacctgtaatcccaggtatttgagagggaggcaggagaatcacttgaacctgggaggtggaggttgcagtgagccgagatcacaccactgcactccagcctgggtgacagagcaagactctctctcaaaaaataaaataaaataaaataaaataaaataaaataaaataaaataaagagccgagcacgctggctcacacctgtaatcccacacttcgggagaaagaggtggcaggattgcttgagcccaggagtttgataccagcctaggtaacatggcaaaatcccatctcaattttaaaaaaattttaaaaaagaataatagggctgggcacgatggctcatgcctgtaatcccagcactttgggaggccaagatggatggatcacctgaggttgggagtttgcgaccagcctgaccaacatggagaaaccccatctccactaaaaatacaatattagcaggtcgtggtggcacatacctgtaatcccagctactcggaaggctgaggcaggagaatcgcttgaacctgggaggtggaggttgtggtgagccaagatcgtgccattgcactccagcttgggcaacaagagtgaaattccatctaaaaaaaaaaaaagaaagaaagaaataaggtattttacataaagattaaaaagaaattaaaaccattatttgaagataatggcttaaacagaaactctgcaaatccttagaataagaaagttcaggccaggtgtagtggcttgtgcctgtaatcccaatgcattgggaggctaaggtcggaggattgcttgagcccaggagtttgagacaagccgggtcaacataatgagatcgcatctctacaaaaaattgaaaaatgagccaggtgtggcagtgcgtgcctgtagtcctggctactcaggaggctgaggtgggaaggtcacttgagcctgaagagttcaaggctacagtgttatgatcatgccactgcactgcactccagcctgggagacagagcaagaccctgagaccctgtctcaaaaaacaaaataaaaaaccctcactatattgaacacaacatcaatgttcaatagccactctccttctccttttctaataaaattccacttttttgtgttccatcccaggaccacgatttatctaaactggtcattctggatcaataagtttggctaaaaataaataatatcgaaattggtcacaggaaatctattcttttttttttttttttttttttttttcagacaaagtctcactctgtcgcccaggctggagtgcagcagcatgatcttggctcactgcaacctctgcctcccgggttcaagcaattctctgcctcagcctcccaagtagctgggattacaggtgcctgccaccacgcctggctagtttttgtatttttagtagagatggggtttcaccatcttggccaggctggtcttgaactcctgaccttgcgttctacctgccttggcttcccaaagtgctgggtctgtcacccaggctggagtgcaatggtgcaatcatggctcactgcagcctcaacctccctgggctcagatgattctcccaccttagcctctcaagtagctgggattaaaggcatatgccaccatgcccagctaatttttctattttttttgtagagacagggcatccctaccttgcccaggctggtcttcaactcctggtttcaaaggatcctcctgcttcagcctcccaaagcactgggtctattattccctttcatattcaaacttaattctgcattttcaaggccttgaattttcaagggcagctttttctgtccctgaacttaatcttcagctcctctcacctcctgggaggttggggggtggggaagaaaagtcccaaccctctaatcctgctttggtcttttgccgccagcccccatcctgaagctaccagtcaatttgtttgcatacaagaagatatcactttggagattctaagtgtatacgaggaaatgaggtcaaagaccaaatatatatatttcactatatcacacttcaaacttttgtttactgtttcccttctcctactctattataaacctttgagggtggggactgtgagttatttatctttatattcccagtgtcaagagtgtttagctataatgggaatgaatctcaaagtttcttgaataaatgacaagaagaatcatagttgcatgaactaaattcattattctcagtccttgaggtaaatgaatatattgatattatgtctgcttactctttttttgcgagagagagaaagaggagggagggagggaaggaaggaaaaaaggaaggaaggcgaaaagagtgaaagaaaagagagagaaaaagagagagaaagaaggaaggggagggaaggaaggaaaagaaggagggaagaagggaaagggagggagaggaagaaaagaaagaagaaggaaggaaagaaagaaagaagaaaaggagggaggaaggaacgaagaaagggaaagaaggagggagggagggaaatgaaggaaagaaagaaaaaagaaagaaagaaaaaagaaaagaaaaggagggaggaaggaaggagggagggaaggatggaagaaagggaaagaaggagggaggaagggacatgaagagaataaagaaagaaagaagaaaagaaaagaaaaaagaaaagaaaagggagggctctgcgggcggcggcggcgcggggagccggttgcaggccgagatgctgcagatggacctgatcgacgcgacgggggacactcccggggccgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgcagttgtctcaggacacactgaataataattctctgggcaaaaagtacagttggcaggatcgggtgtctcgatcatcctcacccctgaagacaggggagcagacaccaccgcatgaacccatttgcctgagcgatgagctgcccccccagagcagccccgcccccaccacagatcgaggcacctccaccaacagcccacgctgctggagctggtgagcctgcggccgtgcttcagagactacagtgacgagagtgactcggccatcgtctacgacaactgtgcctccgtctcctcgccctatgagtcagccatcggagaggaatatgaggaggcctcccggccccagcctcctgcctgcctctccaaggactccacgcctgacgaacccgacgtccatttctccaagaagttcctgaacatcttcatgagtggccgctcccgctcctccagtgccgagtccttcgggctgttctcctgcatcatcaaccgggaggagcaggagcagacccaccggaccatattcaggtttgtgcctcgacacgaagacgaacctgagctggaagtggatgaccctctgctagtggagctccaggctgaagactactggtacgaggcctacaacatgcgcactggtgcccggggcatctttactgcctattacgccatcgaggtcaccaaggagcccgagcacatggcagccctggctaaaaacagtgactgggtggaccagttccgggtgaagttcctgggctcagtccaggttccctatcacaagggcgatgtcgtcctctctgccgctatgcaaaagattgccaccacccgccggctaaccgtgcactttaacccgccctccagctgtgtcctggagatcagcgtgcggggtgtgaagataggtatcaaggccgatgactcccaggaggccaaggggaataaatgtagccactttttccagttaaaaaacatctctttccgcggatatcatccaaagaacaacaagtactttgggttcatcaccaagcacctcgccgaccaccggtttgcctgccacgtctttgtgtctgaagactccaccaaagccctggcagagtccgtggggagagcattccagcagtttcacaagcagtttgtggagtacacctgccccacagaaaatatctacctggagtagccgcgcagccccgccctctgcgtcccccggccctcaggccagtgccaggacagctggctgctgacaggatgtggcactgcttgaggaggggcacctgccaccgccaggggatgaggaagtgggggccgctggctcagggtaggggagggtggggcaatggggagaggcaaatgcagtttattgtaatatatgggattagattcatctatggagggcagagtgggctgcctggggattgggagggacagggcttggggagcaggtctctggcagagaaggatgtccgttccaggagcacacggccctgccccatcctgggccatacctcccctgccagggctcgggtgctctggctcctgccttgatgaagcccatgtcctgccttgatgaagcctgtgccacctgcaagtgcccgccctgcccctgtcccaacacccaccgaagagccctgagctcaggctgagcccagccacctcccaaggactttccagtgaggaaatggcaacacatggaagtgaagtccctgttctcagctctgtcatctgcagggcttctgggtggctcctgccactgacctcactggcatgctagcctgtggcaggcctaggacctcagcggggaggaggagctgctgcaaggccctatcccagcaggagagggaggcttcctgactgacacaggctagccccatcttggtcctgtcaccctggccccaactattaaagtgccatttcctgtcaaaaaaaaaaaaaaagaaaagaaaagaaaagggagggagggagggaggcaggaaggaaggaagagagggagggagggaagggaggaagaaagggaaagaaggagggagggagggaaatagaaagaaagaaggaaagaaaaagaaagaaagaaagagaaataaaataaaaattaaaaaaccataaggttaaagtaaaccctttttcttcatacagattaaaacacatgacttcaaattacagctttgcttcttaatagcttggtgatgtaggacgttatgtaacctctctgtgcctcagtttcctcatttataaaatagggcaataataatatctagcccataaggcattgtgaggattaaatgtgaaatgctgatcacaaatacctagcagcccaatagatactcactgtaataattattatttttataatttctgcaaaagtatggtgatgattcttgggttaacctaaaggcagattttcttttatttcttcctgtttcttttcttttccttgttcactttaaagaattaaaaagaaaattgattccagcattttggaataaaaatttgcatcaaaaagaatttattcattttattgacatacaaataaaatgtcatttgtttattcaataaacatttattaaatgtctggtaaatttcagacatcatgccaggcacagggatgacaatgacaataagatgtggtctctgccctcagggagctgatagtccaggagactgacaagtagacaggtgattacatgcaatgtaacaaaggctatgatgtcatacaagaagacaagtgggagtatgtgatgggagtatggttttgaccagttcctcctcttagatttatccctttttctttggctataaagcaaaagaattggtcctatttttttttcttaactttgcaaattaaaccataaattttaataactttataaagataaaaggcaagcggtcagattcagtggctcacacctataatcccaacactttgggaggccgaggcaggtggataacctgagatcaggagttcgagaccagcctggccaacatcgcgaaaccctgtctctactaaaaatacaaaaattagctaggtgtggtggcaggcacctgtaatcccagctactcaggaggctgaggcaggagaatcgcttgaacctgggaggcggagtttgcagtgagatgagatggagccattgctctccagcctgggctacagagcaagactctgtctcaaaacaaaacaaaacaaaacaaaacaaaaagatgagcaacttgaattatggaggacactagaaatagtgtttcctacagaatcagggcttcctaccaacatagtcacttctagggttttcgacctgaaaagttctgtggcatattgtttctttgctatccacttttttttccctatttttccccctctttctctcctctactttatctcctagagatctaggtagttcccaaaggaataatgctttacggagtctaatgttgatttattaggtaaaaacagaaaatgacttttttttttacccacaagttccataccaaaaaatgaatgtaaacttcttatgcagtttcacacattgaaaatgcaggttattttaattccattgcatttttcagaattctcaatcgcaatcctctgacaactgttgaagatccgtatctctttaaattactggcattaaaatatctgtaagtactatagtactcttgggagtcatgagatgatttatactctttttaaatttttcatcaaagattaagtattttgcatttaggctaaaatgtcataatttaaattttaactgagttattgaaaaacattattggcaaaggaaaggatgtgtaatggtcaagatagccagcaggggaaagagaacagtgttgaagaacccatatagatttggaacatgtagacacatggaggaatattacttaaccaagaaagcaaaggggaaaaggtgttcattattctaaaaaggaagaaaagagtaaataatcaagatgggtgaatgcaatatgaaaatgagaagtaagataatggtaaaaaaaaaaaacagtgtaagacctactcttgaatatcattaatttgatgatgcaaatcaactttaatttctttaataagagctctctggaattttgcggcaaataaactgttgaactggcttgttttatagggaagccaaaattgaagtaatcacatgtccttgaattatctttttaagtacagaattttttactggggttcatatcatgaatgtttcggctttcttcttcagagacgtgggaacaacgcaagtcccacttacaacacttaagaacattctcatgatgaccgttgaactggaaaaactgtaagttatttttttcttagacttattttcaccctgttgcgtttttaggtttgttttattattttcttaagtcaggtttattgagatataattttcatatactaacattcaccctttttaagtgtacaatttgatgagttttgacaaatgtatagttacataaccaccaccacattcccaatataaagcatttctgtcgcctcaaaaaggtccctcgtgtccctttgtagtcaatcacctcctcccaccgtcagcccctgttagctactaatctgatttcctatagttttgccttttccagaatatcttataaatgaaatcatatagcatgtagcctcttgtatttgacttctttcacttagcataattttttcttttttgagatggagtctcactgttgcccaggctgcagtgcagcggcatgacctagactcactgcaacctccacctcccaggttcaagtgattctcctgcctcagcctcctgagtagctgggattacaggcacatgccaccacgcctggctaatttttgtatttttagtagagacgaggtttcaccatgttggccaggctggtttggaagtcctgacctcaagtgatccgcccgccttggcttcccaaagtgctaggattacacgtgtgagccacctcacctggcctcacttatcatattattttttgaaattatgctgccatccatgttgctgcacccatcactacagctggccctccatatctgcaggttcctcatccatggattcaactgaacatggatggagaatacttgaaaaaaatgaaatatataaaataactataagacaataaaaacagtagaaaatttaaaatacagtataattatttacataccatttacactgtattaggtatttaaagtatacctgaggctatatacaaacattatgtcatttcatagaaaagacttcagcatctgtggactttggtgtcggcagggggtcctggagccaatcccctgcagacaccgagggacaactgttcactcctttttattgctcagtagtattccagttgtgtggaaaccccatctctactaaaaatacacaaattagccagatgtggtggcacacacctgtaatctcagctactcaggaggctgaggcacaagaagtgcttgaagctgggaggtggaggttgcagagtctcctttacacttgctgtcctccctccactgccgcctgacacactcctccccagcagtggcctcttcataggcaaatttaaggagcaccttttagtccttgtcctgcttgacttggccctgatgtttgaaattcttgataaatctttcttccggaaacacactctttctatgcttccaggaaatctttttcttggttctccagacaacttcttagactccttgaccaattccttcttgttgccaacaatggaaacaaaccagccctacctaagcaaagcacattaaaactcactagaaagatacaggggagggggcgcccactaaaccactaaagagacaggaggtggggagctgtaggaccaggtttgggaacctgcaagaatcaagaccagagcccctgaaatagcaagaagctggaagcacaggaactgtcagagccagatggctgtcactgcagtcagcgcctctgattgtttgtttttgagatggagtctcgctctgtcgcccaggctggagtgcagtggcatgatctcggctcactgcaacctccacctcccgggttcaagcaattctcctgcctcagcctcccgagtaactgggactacaggagcctgccaccatgcccgactagttctttatatttttaatagagatggggtttcaccatgttcgtctcaaactcctgaccccaggcgatccacttgcctcggcctcccaaagtgctgggattacaggcgtgagccaccatgcctggccagtttttgtatatttagtagagactggttttgccatgttggccaggttggtctcaaactcctgacctcaagtgatccatccacctccgcctcccaaagtgctgggattataggcatgaaccactgtgcccagccacctctgatagttttcatcgtcctcgggccactggctcccaaatcacggttccagacaaaagcttacaagtagtccagctttggccaggctcagtgtgatggttaatactgagtgccaacttgattggattgaaggatacaaaatattgatcttgggtgtgtccgtgagggtgttcccaaaggagattaacatttgagtcagcgggctgagaaaggcagacccacccttaatctgggtgggcacaagctaatcagctgccagcaaggctagaatataagcaggcagaaaaatgtgagagactggcttagcctcccagccaacatcttcctcccgtgctggatgcttcttaccctccaacatcggactccaagttcttcagttttggaactcagactggctctccttgctcctcagcctgcagacggcctattgtgggaccttgtgatcctgtgagttaatacttaataaactcctgtatatattccattaattctgtccctctagagaaccctgactaatacgctcagtgactcacacctgtaatcccagtactttgggaggctcaggcaggaggatggcttgagccccagagtcttcttcttctccttctccttgtccttctcttcccttcccctttctcctcttcctcttccttctcttcctcttcctcttcctctccttcctcttcctcttcttcctcttgtttgtttgagaaaggttctccctctgttgccaaggctggattgtagtggcacaattgtgactcactgcttctcagcctcctgagagcccaggagtttgaggctgcagtgagctatgatcacactaccacactcctgcctgggtgacagagcaagaccctgtctcaaaaaacaaacaaaaaactctggtatgatagaggtgaattgtctgttttatcctgataattctgcttaccttagtcccgtggttctcaactgggccaattttgctccccaagtgacatttggcaatatctgggcagaggtcaaggacgctgcttaacatctttttttttttttttttgagacacagttttgctcttgttgcccaggctggagtgaaatggcacgatctcgcctcactgcaacctctgtctcccgggttcaagcgattctcctgcctcagcctcccgagtagctgggattatgggcatgcaccatcacgcctggctaattttgtatttttagtagagatggggtttctccatgttggtcaggctggtctcaaactcccaaccttaggtgatcagcccacctcagcctcccaaagtgctgggattacaggtgtgagccacctcacctgtcctgcttaacgtcttaaaacacacaggacaattcccccataaaaaatgatgaccagccgaaaatgtcaacagtatcaaggtgaagaaattgccataaaggcttggtaaacagggatggtatgacgacactattgataggccacattaaaatacttagggccatatccattatccctgtttttatgatttcttctttgtccccatgcagtttcaggggcaaaataagggagtaagtcagaggtggttccaaatagacatctgggaatcttagggtgtaatatggccctcatggaggcccttgctgagcttagggcctgattctggaatcctagcattgccaagagaggcaggctggcaggtgagaagacaaataatgggagagcccacatatgttggaattcatttgatggtatctaagctggggtgattgtccccactagcattacatgactatggatccagttatttggagaaatccatttcctccacagggaatatatactacattagaaccaaagatggaatccttagtaaatggaatcatttggcaaaattcagttgtctgaaatttttgcataaaattctcttttttattttcattgagccaaataaataaagtatcaggtatttactggggtcaccattctttgattcattgattttttttttcagacaggatctcgctgtcacccacgttggagtgcagtggcataatctcagttcactgcaacctccacttcctgggcttaagtgattctcccacctcagcctcccaagtagctggaaatacaggcgcgtgccaccatgcctccattttctttctttttttttttttttaattgatcattcttgggtgtttctcgcagagggggatttggcagggtcataggacaatagtggagggaaggtcggcagataaacaagtgaacaaaggtctctggttttcctaggcagaggaccctgcgccttccgcagtctttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtatagaacaaaatgaaaagtctcccatgtctacccgcctctacacagacacggcaaccatccgacttctcagtcctttccccacctttcccccctttctactccacaaaaccgccattgtcatcatggcccgttctcaatgagctgttgggtacacctcccggacggggcggctggccgggcggggggctgacccccccacctccctcccggacggggtggctgccgggcggagacgctcctcaattcccagacggggcgactgccgggcggaggggctcctcacttctcagacagggcggttgccgggcggaggggctcctcacttctcagacagggcggttgccgggcggagggtctcctcacttctcagatggggcggccgggcagagacgctcctcacctcccagatggggtcacggccgggcagaggcgctcctcacatcccagacggggcggcggggcagaggcgctccccacatctcagacgatgggcggccgggcagagacgctcctcacttcctagatgggatggcggccgggcagagacgctcctccctttccagactgggcagccaggcagagacgctcctcacttcccagacggggtggcggccgggcagaggctgcaatctcggcactttgggaggccaaggcaggcggctgggaggtggaggttgtagccagccgagatcacgccactgcactccagcctgggcaccactgagcactgagtgaacgagactccgtctgcaatcccggcacctcgggaggccgaggctggcggatcactcgcggttaggagctggagaccagcccggccaacgcagcgaaaccccgtctccaccaaaaaaatacgaaaaccagtcaggcgtggcggcgcgtgcctgcaatcgcaggcacttggtaggctgaggcaggagaatcaggcagggaggttgcagtgagccgagatggcggcagtacagtccagcatcagagggagaccgtggaaagagagggagagggagaccgtggggagagggagagggagggggaggggagggggagagggagagggagaggtgcattttcttataaacccaatttcctctttagtgcaactctaccatttgaaaggaacctttctattgtaatttacaagctgtgaataaccgctatgtaattctttccaaggattaataaactgagagaggatttgaaccaacagaggtaggggaagattagaagggggatgcaagtggccacagatcttagaggcggccagcagagggcgctgctccaaggtgaaggtcgcaccctgagaggccatccttttttgtaggaccagactggggtgtaaggacagtgcctcatcctcacaacgacagacccgtgttctgggtgtggatttgcctcccttgcctgcgggacttctgctagcactgccgttcctagacttagaccatgctagaatgagtccaggaaccgaggagaggagatgggagtggctcctcccactgtggcccctaataattcacatgaagaatttttgctttccttgccagggacccgggactcagtgggtccagaggtcctagtgccaaaggaagaaatgtgtagatcaggaaatactattatggttttattcaactggaagccgaggctggccatttattgtatttatttatttatttatctatctatttatttatttatttagagacagaatctcactcttgtttcccaggctcccaggctcaagagatcctcctaccttagcctcctgagtagctggtactacagtcgcatgccaccttgcccagctaattttttttttttttgagacgcagtctcattttgttgcccaggctagagtgcagtggcgcggtcttggctcactgcaacctccacctcctgggttgaagcgattctcctgtctcagcctccggagtagctgggattacaggcatgtgccaccgcgcctggcaatttttttttttttagtagaggcggggtttcaccatgttggccaggctggtctcaactcctgaccttgtgatccgcctgcctcagcctcccaaagcactgggattgcagacataagccaccgcgcctgttttttttgttttgttttgttttctgacagagtctctgtcacccaggctggagtgcagtggtgtgatctcagctcactgcaacctctgcctcctgggttcaagcgattctcctgccttagcctcccaagtagctgggattataggcgcacaccactatgcccagctaatttttgtatttttagtagaggtggggtttcaccatgttggccaggctggtctcaaactcccgacttcaggtgatccacccacctcggcctcccaaagtgctgggattataggtgtgagccatcaagcccagccctgcccagctaatttttacactatgggcaagtatgctgcccaagagtgctctggaactcctgggctcaagtgatcttccttcctcggcctctcaatgtgcttggattacaagcatgagccaccttgcccagccgaagctggccatttaaagttcctcatgctgctgaatcaataaggatggaaggcggctactattatgggctaagtgtttgcatcctccccaaattctttttttttttttttttttgagatggagttttgctcttgttgcccaggctagagtgcagtggcgcgatctctgctcactgcaacctccacctttcaggttcaagtgattctcctgcctcagcctaccgagttagctgggattacaggcatacgccaccacacccggctaattttgtatttttagtagagatggggtttctccatgttggtcaggctggtctcaaactcccgacctcaggtaatctgctgacttcagcctcccaaagtgctgggattaccagcatgagccaccgcgcccggcccccaaattgttttttgttttttttttttgagacggagtctcgctctgtcacccaggctggagtgcagtggcatgatcttggctcactgcgagctctgcttcctgggttcacgccattctcctgcctcagcctcccgaatagctgggactacaggcgcccgccaccacgcctggctaattttttgtatttttagtggacacggggtttcaccgtgttagccaggatggtctcgatctcctgacctcgtgatctgcctgcctcagcctcccaaagtgctgggattacaggggtgagccaccacacccggcctcggcccccaaattcttatgttgaagccctcacctccatgtgatggtattagaaggtggggcctttgggacgtaattaggctgacagtgccccatgatgggatgagtgtcttaaaagaaaagaccaggtggtctggctagtggctcacccctgaaatcgcagcactttgggaggccaaggtgggtggatcacttgagatcaggcgtttgagaccagcctgggcaatatggtgaaaagccatctctactaaaaatacaaaaattagctgggcgtggtggcgcaagtctgtaatcccagctacttgggaggctgaggtgggagaatcgcttgaacccaggaggtggaggttgcagtgagcccagatcatgtcattgcactccagcctccaacctggacagagagagcatctggagagtctctgtctcaaaacaaaaagaaaaaaaaaagaagagaccagagagcctttcttctctttgtccaccaagtgaagatatggcaagaaggcagccatctgcaagctaggaaaagagcccttgccagcacccaattgtgctatcaccctgatatgggacttcccagcctccagaactgtgagtaatcaatgtctattgtttaagccacccagtatgtaatactgagctgactaaaaccatcaccgaactagcctctttacatatgattagcaagaggaaaatggctctgttacttaatggaggaaggaggctatgtctgaaagccaaaaattcactggggacacatcttagcaggctcttgaccctaagacctggttaatggaaaagtagagcaacccaataaaaacaagaccaccaagaagtcaggtcttatggaataaagtattgagtgtccctatgaggcacagaacccttcgaaaggggattggaagaagtggtgaagaaggcggctatgattatcaacttagacttcatcgccatttgtagaaggaggcttctaacagctatgttttatgttaattggctcttttctcttcttttttctttcaaccttatattaagagcactggcagaagctagcggttttggcatcctgtaattattagctgtataaccttggccaagtaactcaacctttctgtgcctcagttactcatctgtaaaacagggtaataagtctcaacctcgtacttatgttgttataaagatttaacactaggctgggcatggtggctcacacctgtaatcccagcactttgggaggccgaggagggtggatcacctgaggtcaggagttcaagaccagactggccaacatggcaaaaccctgtctctactaaaaatacaaaaaattagctgggtgtggtggcacgtgattgtaatcccagttactcgggaggctgaggcaggagaattgcttgaactaaacctgggaggcggaggttgcagtgagccaagatcgtgccactgcactctagcccaggcaacagagttagactctgtctcaaaaaaaaaaaaaaaaaaaaagtaacactttgaacaaaaaagaaaaaaataataaaatttaaaaaagatttaacaattgggccaggcatagtggctcatgcctgtaataccagcactttgggagcctgaagagggaggattacttgaacccaggagttccagaccagcctggacaacaaagcaagactttgtttctacttaaaaaaaaaaaaaaaacaccaaagtcaggtgtggtggtacacacctgtgatcccagctacttgggaggctgagatgggaggatcccttgagccttggaggttgaggctgcaatgagccatgatcataccactgcactccagcctaggcgacagagtgaggcccatgtcaaaaaaaaaaaaaatgatccccaacatttagcagcttaaaacaaaaaacatttattatatcacactttctgtgggccaggaatctgggagggacttagctgggtggttctgctcagttctcttgggatgtttcagtcaagcagtggcctggggctgcactcttatctgaagactcaattgggagaaaatatgcattcaaggtcactcattggttgttggcaggctgtagttccttactgaatattggttgaagacttcattggcttactacctggacttctccatagactgcttgaatgtcctccccacatagctagagtgaatgactaaaaaagagagagaacacacacagcccaggtaagagttcagtctttctaagtcattatatgaaagagattcttttttttttgagatggagtctcgctctgtcgccaggctggagtgcagcggcacgatcccagctcactgcaacctctgcctcctgggttcaagtgattctcctgcctcagcctcccaagtagctgggattacaggcgtgtgccactatgcccagctactttctgtatttttaatagagatggggttttaccatgttggccaggatggtcttgatctcttgaccttgtgatccacctgccttggcctcccaaagtgctgggattacaggcgtgagccaccacgcctggccgaaaaagattcttgcacacacatgtttatagtagcactattcacaattgtaaaaatgtggaaccagtccaaatgcccatcaatcaatgagtggctaaagaaactgtggtatagatatacagtggaatactactcagtcataaaaaggaatgaattaatggcatttgcagcaacctggacaggattggagactattattctttttttttttttttttttttttttgagatagagtctcacttggtcacccaggctggagtgcagttgtgcaatcttggctcactgcaagctctgcctcctgggttcacaccattctcctgcctcagcctcccaagtagctgagactacaggcgcctgccaccacgcccggctaattttttttttgtatttttagtagagaccgggtttcaccatgttagcctggatggtctcgatctcctgacctcgtgatccgcccacctcagcctcccaaagtgctgggattacaggcatgagccaccgcacccggcctattttttttttttttttttttttttttttttttttactaaccaggggtttaacataaatacaaccagcatagaaagacccaaaactatacagaaaccaaaaccagaatgccatgtggtggaggcaaagggcagaatttctgacccctttggctcagctgcccttccccacaaataaaaaccaacaaagaggacaaatcaggacaataaagaagattcatgctaagctgtggcagaggggggaaggtatgatcgggtgggggtgggataaggaatggccatggaagataactgggtcaggttggaccctgggctgggagggggagggcaaggcccctcaccacaacttaagccaaacctaagctgcccccaggtgccataggtccctgtcccagcagggaggctgatgggcctgggcccatgcccctccccacctttgggggtcagatagtggccacccaggtttgctgggttggggcctgatacaggctctgcatgcccattcgggctgcctgtggagagagaatggagtcactgtttaaccatgctacctgcctcagccccagcagaccacaggaggttggccccagactcactgagtgcctgcagcagccctacagacacagcatccttggccacctcatgcccatcccggccatctagggtcagcacaacccagatgaggccgctgaagggcaccggatgcccaggaatcaccacctggtaccagaagcggtgccagccagcaggtcctatgcccaaacacttggtgaggaacacagggctgcccagcttcattcgttggcacagcaactgcagggtagcccgagccccttgggaccctaacttgtcccttgccaaggccaactggctgccctctggctgtggggaccgcaaggagggacccacaagctgctggcgaagtcgctgcttcagttctggcttgagccactccacagccacctgctctccacagaggtgtggctgcccttcctccagggcctttttggccatggcagcggtccagtgcgagctgaatttgagcagagcgatctgcccgggcgcaggtccggggctgggcagcagccgcgcctcctgcaggccgggacccagcggctgcagcgcgggcagcagcgcgggcagcagcgcggtgcgggtcagattcggcggcaggcagtcaacgctcagctcacacttcccggtgctgcggcacacgagcagcgggcaggacggccgcagcgggtggttgtgcagcgggcgatggcggcctgcgcgccgcgccgcgagctgcagcgggcatatgcgaagccgcggttcaggccgctgaaggtcatcatcaggcggaactcgtagaggcggcccacgcgctggaacagcaggatagctggtgctcatacacttcctgaggcagccgcccgatgaacacctctgacccagccggcggcgggctgcccacccagcctgggggtggcccgccatacttcctctgcccgttcacctgcaccaggcgatgcctgtctccctgacccacgcctccagcgccgccttcaccctctcacaccacagctcacaatcccgcttggactgcatggctctctattctcttttttttttttttttttttgagacgtagtttcactcttgttctccaggctggagtgcaatggcgggatcttggctcaccgcaacctccgcctcccgggttcaagcgattctcctgcctcagcctcccaagtagctgggattacaggcatgcgccaccatgcctggctaattttgtatttttagtagagacggggtttctccctgttggtcaggctggtctcaaactcccgacctcaggtgatccacccacctcggcctcgcatagtgctgggattacaggcatgagccaccgtgccccgtctatggagactattattctcagcgaagtaactcaggaatggaaaaccaaacatcgtacgttctcactcataaatgggagctaagctaggaggatgcaaaggcataagaatgacacagtggactttggggaatcagggggaaaggatgggaagggggtgagggataaaagactattaattgggtgcagtctatattgcttgggtgatgggtgcacacaaatttcacaaatcaccactaaagaacttacttacgtaaccaaacaccagctgttccccaatatcctatggaaataaaaatttttttttagaaaaagagttcggtctttctgtaacctaatcttggaagtgtatattatcacttcttccataggctatcagtctcccagaccaaccctgctacagggtaggggagactacatggtatgtgaataccagaaagtgggggccactggggactggctatttggaggatggttactacaaactatatttgtaattttttttttcttgagatggagtcttgctctgttgcccaggctggagtgcaatggcacgatctcagctcgctgcaacatccacctcctgcgttcaagtgattctcctgcctcagcctcccgagtagctgggattacaggcacgcaccaccacacccagctaattttttgtatttttaatagagatggggtttctccatgttggtcaggctggtctcaaacgcctgacctcaggtgatctgcccgcctcggcctcccagagtgctgggattacaggcccgagccatggtgcctggctatatttgtaatattttaaccactaaaaaaaaaaaaaagaagaagaagaagaagaaaaagaaacaagtatgggaaaatattaagatctgataaaaccgggttatacttatgcaggtattcattacattattctccataactttttaaatgtttaataataaaagtaaaaatattttccccttaaaaatgtgcagagcatacctcaaataatgttgacaaagaatcctaaagacaattattattattattattttttgagacaggttcttgctctgttgcccaggctggagtgcagtgatgccacctgagctcactgtaaactccgtctcccgagtttaagcaattctcctgtctcagcctcctgagcagctgggactacaggcgagcaccatcatacctggttaatttttatattttcagtagagacggggtttcatcatattgcacaggctggtcttgaactcctggcctcaagtgatccacccaccttggcctcccaaagtgctagcattacaggcatgagccactgcaccgggcctctcaaactcctgacctcaggtgatccacctgccttggcctcccaaagtcctggcattataggcgtgagccactgcgcccggccgatcttccttcctttctcccttcccctcttcttcttcttcttcttcttcttttttaattaatagagatgggattttgccatgttgcttaggctggtttcaaactcctgggctcaagctatctgctcgcttcagcttcccaaagtcctgggattaagggcgtgagccactgcgcctggccccagtaaggatttaaaagctcaggaattattagtcagcttccttttttgttcatcctgttgtttgttcatttcagtctattccctttttataatttccttcttcataaggactatttctccttgtacttttgtgagaattcccgtaacttgtaatcccagctacttgggaggctgaggcaggagaatcacttgaaccgggaggcggaggttgcggtgagccgagatcaagccattgcactccagcctgggcaacaagagcaaaactcggtcttggaaaaaaaaaaaaaagaaaagaaaagaaaaaagaaaggaaggaagatcctcattggacagagcaaaaagcagaattgatggcactgaaaatgaaatcagcagctgatgtacaagttccagaatgtctcctagagtaacaaggaaatccgggtgtggtagtttatgcctgtcatccaagcactttgtgaggccaaggaggttagttagcttgagcccaggagttggagaccagcctggccaacatggtgaaaccccatctctacagaaaatataaaagttagctgggtttggtggtgggtacctgtagtcccagctactctggaggcgaaggagggaggatcacctgagtcccgcgaggtcaaggccacagtgagccttgatagagttttgccactgcactccagcctaagcaacagtgagaccctgtctcaataaacaaacaaacaaacaaataaataattgtagagacagaagataaaatggagcccggtgcagtggctcacgcctgtaatcccagaactttgggaggctgaggtgggcagattacttggcccaggagtttgagaccagtctgcccaacatggtgaaaccccgtctctactaaaaatacaaaaattagccaggcatggtggtgtgtgcctataatcccagctacttgagaggctgagacaggagaatcgattgaacccaggaggtggaggttgcagtgagctgagatcacaccactgcactccagcctgggtgacaaagccagactctgtctcaaaaaaaaaaaaaaaaaaaaaaggctgagcacggtggctcatgcctgtaatcccagcactttgagaggctgagccgggcagatcacctaaggtcgggagtttgagaccagcctgaccaacatggagaaaccccgtctctgccaaaaatacagtattagcaggtcgtggtggcacatgcctgtaatcccagctacctgggaggctgaggcaggagaatcgcttgaacctgggaggtggaggttgcagtgagccgagattgtgccactgcactccagactgggcaacaagagtgagactctgtctcaaaaaaaaaaaaaaaaaaaagagagagagacagggtttcaccaggttggccaggctggtcttggactcctgacctcaagtgatctgcccgcctcagcctcccaaagtgctgggattactggtgtgggccactgcatctggctcccaccatctctattaaaataagataaaataaacataaaataatgaaccgacaaaataataatacaattcattgtaagtaaaatgctatcctgagttctgtgagtcattctggataattcaaattctctagaattaccacctcagctgactttttttttttttttttgtagagaccaggctggtcttgaattcttgagctcaagtgatccgcttccctcagtctcccaaagtgctggaattacatgtgtgagccactgagcctggcctacaaattctttattatacaacacacagtagatgctcaataaatatttgctaagcagaaacatacactcaaaataccagaaattatcaaggaagttgccagttggtctcttgggttcttcctcccgacaggtatacacacctattgtaaagatgaacacattaggctgtgagaaaccaatactgttaaacattccaatcaggtgacaaactccctgggctctggtttatattaccaagcaacctgatgataacttggcttcctgtgtggcttgtttatagaaagagaatgctacccaggctgacgtgagttgcatttctgagttgatttctcactgtaaattaataaactggcattctggctacatagatcagtctctttgaactctttgtaccttccaccattagtgtgatttctaaggctgcaagccagacactgcccaagacccagcactggactctggtgagttcttccagctgttgccaccccaggaggctctgggagcccctgggaaccatccagcttgctctctgtctctacatttcagggtgtgggtttcagggcattcacaacattcctgcaacagaagagttttgggaacacccccagcaggatgtgggtgatttgaatgtatgtcagagatgtggttgtaactgagaaatcttaagcctagtgaattttattccacttgacttaaataaagagcacgtgaaagaaggggatctgaggacatctatgaacagggccccgagggcatgaacttactagtgtttatatgactagtgtttatctgggcctgtctagtctggagaacctgactctggtgtacccaagctttgcagtggctgtagaggtttgctcttttggagggagaagataattcattcctccaacacctgaatgagggtagattaacccacctccttcagctgcaatttggcaaatttctcttctttgatttaatgctcaacggacaaatttcctttcttcttcttcttcttcttcttcttcttcttcttcttcttcttcttcttcttcttcttcttcttcttcctcttcttctttttttctcctcttcttcttcttcttctcctccttctccttcttctccttcttcttttctcttccttctcctcctccttcctcctcctcctcttcctactcttcttcctcttcctctcctcctcctcttcctcctcctcttccttcttcttcttctttctttttttttcggttttgagacagggtctccgtcacccaggctggagtgcagtggcacgatctcggctcactgcaacctccacctcctaggctcaagcgatcctcccacctcagcttcccatgtggctgggaccaaggcgtgagctaccatgcccggctaatttttgtattttttgtagagacagggtctctccatgttgctcaggctggtcttgaactcctgagctcaagagatcctcctgtctcaggctcccaaagtcctgggattacaagcacgagccaccatgcccggcctcaacaggcaaccttctgattaataattagacctctgtgccggccgtcgtggctgatgcctgtaattccagcactttggaaggccaaggcgggtggatggcttgaggtcgggcgtttgagaccagcctggccaacacggtgaaaccccgtctctgctaaatatacaaaaattagcctggcatggtggcgtatgcctgtaatcccagctacttgggaggctgaggcacgagaatcgcttgaacccgggaggcagaggttacagtgagctgtcatatataatgaaacagttttactaaacttaggaagcagtgacttggtgtctctagaaattgcctaacatacacattccaggatacattctctgtcatctggaatctcctcccttccacaaacccacgctgtcttaagcactattttcctatttgttgttgacctaatctagaaaaaagcggccatcactctttctcccccactcagtccctcagtcccgaaacacccttattctccgcacttgtcaccccaccctctgctgcccccaccgcagcgcgcaaacgcacacgagtttaaagtttaggctgtgatgctatcctcgcccgcagatcacaggacagacattctcggggacaactttgcgaggccatgtgctcgtcccccttaggaaggaagagggagaaatccctgcggctcggttttgttccaatggtctgctcagcgagtgattcccgtttccccaaaggctgcccctcattagcatgaacggggacgcgggtgtggagaaggggttagaggagagaaagcaagcaaaagcccaggctcacttttagagcctgggaaccctgtctgcaaaaatgacagctagagctttctggctcctctgtttaatcgtcggatcatcccccgaagctccggtggagagaaaaagtaagatcggtgtagtgcggagccctgggagcggagcggggatctggggagggggcgcccaggcctcagccgccggccgacaaccgggccaccttccgtgaggccgcacacgctcccacaggcccgcgcctggcgcaagccgagaaccgcgcgtcgccgcgccgcgggcccgcgacggaggaagccccgagacgcgcgcgctcacgggccctacgcttccccgccgcccggccgcgcgcgcgcgccgccgagggccccgccggccctgcccaccccaaccggccgcgcgccgttgtgccggcccccggctcgccgcccgcgccgccgccgcgcctcagcttcagattcggcctcagtcagccgcgcagggacgcggagcccggcgccgagctctgcgcttgcgcttgccgggcgggcatggacgggcgagaggcgttctgcaagcgcgaaatcggtgagcccggccgccgcgccgccgccccgcgagcctttccgagtcccggagaatcctgcacgcgagatcccagggcgcccgacccatgcgggccgtttcgctgttgctaaaaaccaacgcccagggactgggagaggaactggggttcccaaactgttttttggaagcagcgatgaacgggatagtgcatgacgtggacgtgctgggcgcgggcatctggctggtgaccctgctggtggatcgggacgggctgtacaagatgaaccgcctgtacctcactcacccccgacgtcttcttcttccgagtccacatgttagtcctggactcctccagctgcaataaaccgtgtccagagtttaaacctggtattgaaactgagctgaatgacgctgcatatgtactttataccaccgtttgtaacgtgggtgccacagcccgggctgtgggtcgtccagtctttttttgggacggatgggggacagtattgtaacatgattaggatttagacgacaggtattatttccgccactgtgatttaagcaccgtcagccccacccccacgggtgagaacggcagctgttggcacaaagcgggctgtcaataaatagatgttgacaaatggagtgagcgaccaccaaacaccattgccagaagggactgtacagaactgagtttagaaaagctgcttttttgggggagtgtgtggagggttggtagcggggaatacccactcccacatcttttttttttttttttttttttttttagacagagtctcgctctgttgcccaggctggagtgcaatggcgccatctcagctcactgcaacctccgtcccccaggttcaagccattctcctgccctcagcctcccaagtagctgggattacaggctgagccactgcgcccagccccactcccacatctttctaggcatgtgctctgggaaatcctgatacaatgtgataaggacctttgttctgtaatgtgggctggttacgtattgctttcccttccccacaccccgtgctactttttgtatttttagtacagatggggtttcaccatgttggctaggctggtctcaaactcctgacctcaagtaatctgcccgcctcggcctcccaaagtgctaggattaaaggcgtgagccactgcactggcctggttgggttggttatcttctaaaggtcgctagactgtttccaccttgcctgtagactaaatatcagtttcaacttgtgcagcaagatagtagattgcagcttaggtatttcttaaaggccttatattttctgtttcatggcatttaaaagacgctatgaattaatgttctggttattttgtccaggcagcaggtatattgtgatgggccacatctaccataagagagggcagcttcctacagctctgctccaggtcctgagaggccatctctgtccaggggatggactgctgaggagcagcagcagctatgtgaaaaggtttaacccaaaaagggaagggcaaattcaaggtgcaattcatacccaatgcatttgaaacaaccatcctggcatttctggatcacaagagacatcggcaacaagacatgaaaggtctatcttcatgtaatgggtcctcctttagaagagagcccaaagctactctatgaatgacctgcatagttacaactgtaatctcgaaggtgtcactttgttatttacaagatgcttcttaaatgggctgctcctgagctcagtgtcaaggtgattcaactgttgtgccagacagtgatttacacagctcagataactgacctgtctagttaacagatcactgcttcatgtttttaaatattttaatttaatacattctttagtagaaatagtccacaaaacattttcctgaatttaaatacacaacttttatatcatgtatcaaacctgattttatattcaaacctgatttatattcaaaacttatatgtgaagattaaattcttcacataacagtaagcgcactagtcaaaagacatttacctatgaaacgtcatttagatcaaacacaagggtcaaagcccaggacaaggattaaaattttacacttaaaaagtaccaagccgggcgcggtggctcacacctgtaatcccagcactttgagaggccgaggcgggtggatcacctgaggtccggagttcgagaccaggctgaccaacatggaaaaaccctgtctctactaaaaatacaaaaattagccgggtgtggtggcacatgcctgtaatcccagctgagggaggctgaggcaggagaatcacttgaacccaggaggcagaggttgtggtgagccgagatcgcgccagcctgggcaacaagagcaaaactccgtctcaaaaacaaacaaagtgtacaaaagggccagtgtgcggatgggtggattaaaaaaataaattttaaaaaagtgccaaagggcttacttcaggcaaaagtgttcctgatgtaccaaagagtaagatatagtttattttcatgcctccctgctcctaataatgtatgttttgtgctgaactggcagctatcccaatgtgaactgtattctgagtgtatctgatatcatttttctattaagaccaagtataatgtttgcttgtaaagcaataaatcttgctttgaaattagaccttggatgcacctgtttatttttgttttgttttgttttagcctttgagccctaaaggtttgagaaaaagcctttctcaaattcattccccaaaccttggaaccaatattaaccaatgacagctcacaagcaagtgaattctaaacatttttcagttggttttaaaaaggtttaatcactagctaaattaaatattgattttatacctgagtccacaaagacatgagagtattttttcagaagataaggctgtacttcagtttataagaagtacggtgaacagagacaccactaatgcatagatgaagatgactgcctaaagagagacaggggaaggaatttcactggagagagagcagcctatttggcctcacggtgatgcactcaggaaggtcagaatgtgtcctgacgctgtccatggcacccagtagtagcactgtacacataaaggacatccaggacgggacgctagggaatcacaggagccaagaggcaacagcctaacattacaatacctgatactattatttgttccaattatggggcagacaggtaataaagagttgagaggttctgagtgttctatggtaaagcactactgagagatttctagagtattttccaaaaatgagttttgtccaaatttattataaattttactagaattgctttttgggagtcagatgcattattgcatgatagaattatagctaatgaagagcttctgagctagttttctttaagataaaaaaaattaactcaggcataactcaggccagtcaaatcaaagttgaatttttaaatgtcaaaaggctaggccgggagctgtgactcacacctgtaatcccagcactttgggagaccaaggcgggtggatcacaaggtcaggagtttgagaccagcctggccaacatagcgaaactctgtctctactaaaaatacaaaaattagctgggcatggtggtgcatgcctgtaatcccagctattggggggcaggaggatcgcttgaacctagtaggcagaggttgcagtgagccgagatcatgccactgccctccagcctgggcaacagagcgagactctgtctgaaacaacaacaaaaagtatatctatatggctaatttctttagttgaatttggttcaaattggatcaagtggtataatcttctaagaaaagtcttttagtatctcactccaagtatctagaaataccttagaatgtttcaaattattaaaaatacttctcggttggctcttccctccacctcctcaagtacttcattattttatccatggaatatccccattctcacattaagggcaagaaatctgagacctatggtaatagtttcttttttttttttttttttgagaaggagtttcgctcttgttgcctaggctggagtgtaatggcatgatgtcagctcaccgcaacctctccctcctgggttcaagtgattctcctgctctagcctcccaagtagctgggattacaggcatgcgccactttacctagctaatttttttttttttttttttttgtatttttagtagagatggggtttctccatgtttgtcaggctggtttcaaactcccaacctcaggtgatccacctgccttggcctcccaaagtgctgggattatacgtgtgagccaccacgcccagccgtatcatgatagtttcaatcaggaagagtgaaagctgtaataaccatgtaactttgtctaactaagtgtgcagagatctgaaagtccaccaggttggctctttaacataaagaagtagagagtttgcctaaaggaattagcagaaatagggaaataacttttatttgcagatcccaggaaggtagattacaaacaacagcaaatcttagtgtctctaaataacactctaggccatttggaatataaaaaggtaattattttacttcagaaaatatctccaaaagttcactttttttttgagacagagtcttgctgtgtcgctcaggctggagtgcagtggcacaatctcagctcactacaacctctgcctccccagttcaagccatcctcccacctcagcctcctgagtagctgggactacaggtgtgtgccacttgtccagctaaattgttgtatttttagtagaaacagggtttcaccatgttggtcaggcaggtctctaactcctgaccttgtgatctgcccgcttcagcctcccagagtgctgggattataggcgtgagccaccatgcccagccacaattttatttaaacctcctgtagaatttggataggagaataaaagctttaccaataggaaaatacttttcatgaaatggtttcaaggattgtgaacttggcaggtgaagcataacagttattgaaaatacttttagccaaggaaatctactgatgcaaattaaatatatttacaagcccaaggcctgtggtagaaacatcctaagagtatcacaaatgtacagtttactgcctggattattgaaagcaaaatagctgtgttatatagatcttaatagcagaagctttcaaagattactcacagaaaagcagctttcagaactcattatgttctaaaaaatgtatgtttttctttcttttttattttttttgagatgaagtctcactcttgtcccccaggctggagtgcaatggcgtgatcacggctcactgcaacctccgcctcccaggttcaagtgattctcctgcctcagcctccctagtagctgggatttcaggtgcctgccaccatgcctggctaatttttgtacttttagtagagatggggtttcaccatgttggccaggttggtctcaaattcctgacctcaggtgatcccccctgcctcggcctcccaaagtgctggggttacaggcgtgggccaccacacctggccaggaatgtgtgtttttcaaaaattacttttgaaagactaaagccctatagttgataaaactataaaatgtctttatgtatttgtatggtgatagaaactgtaaaacactttataccattaaatacacatgaaattaatatcttcctggtctcaggatttccataaaatttaccctttttaatttggcaatgctaacagctacagaagacatattaccaccaaccaaccgttgcttcattagaaactgcaccaaatccaatgtcaaaaacattactttatttttctagtatgaaatgtcctattacatacaaaagaattgctgtttagaatttgccacaatttgttgaaaacatagcaatctattgcctacaggtaggaaagttcttgctgcaacaaattttaaatgattaagcccatatatatttctatatatatgaataaatagtgcagaaatactgtgacgtgatgagatgcagaataattttataattcattaaaatgtagaattcttgcatcagcacagtgcatacaatatgtaactttttttaaaaagtaaaaggacaaaataatccatatttaagtatttccatcttaatattttaagcaaaaatgttttcatgttttcatattgagtgattagtctctttagtttgtaaacataggtttaagtgacatcttcatgtacaaaaaggaatgggcttcattagataaaattaagccagaataacctgtacacctgagcctgtaataagaaagaattgggaactgtagcaacatctttcttttaagaaaccaaggtctgggaaaggttttgcatagcagggaaacgttgaaaggaaggaaacttttaaaagcaataattagataaattccagaagttgataggacaaagctaatatgagttagaataaaatctagtagaatttttgcaaagctgcataatccagctatggcagattttatagaagctattaccacaatgcagtaatacaatgtgtaagaacattgaaaggaagaacatgcaaaatacatcttcctcattttcttcctactgcttacactacttttccttacatggaagaaacaaacaaaccaacaagcaaaaaacaaacccaatcaacaaataacacagaggatgagatcatctaacaaaaaatgtccttcatacaatataagtagctgtctgtaattggtaatttgcccagtatcacagaatgtacagatgaaggcaatgtgtatcttgtcgcattacctttttcgttagtatgatcaactgatgcgacaggattagcacccctgaagattcttctctgacgtgatgacaattgactgggaatgataaaacgaggggccactgctgtccaggagaattccaggtacaattagattcttttgcctttcatgaccttgcagccctccctccccacagaggcttacagataatcattagcacacattcaaagacacctctgtctgtgggagaaaaactatctccatttattttgtttcacatacatccatagttgaattttaatacaaaaagaaaaattagaatctgacaaatgtttacaaagaagataccttcaaatagattttactcatttcaacctggtgtggagtaattgacaaattgtactgttatattcaagtcaccagagtctgtagtccaggaccacttagcccaacctttatgcaagcttgattttaatctaccatgaacaataaactcattgttgattcgcagttgtgtgtgtgtgcacatgtgtacatagcagctcctttcatagaaagaaaagacatctagaggttgtcttgtacttttacgtacaggaatcattgataagatatggatggattatatgtaaccgtggctggattttataagaaaaaataattagttgacaaatgagggcagcaataaaaaagcatcttttttgcaacaataaataaatacagtcaaaagttttctttgagactctaaaccagcttcttcactgaagagcagacgtggcatttccatggagttatacttgaccccacagtatcattgtttcttgctttctttttcttttttttttttaataaacaaaattttctcgcttctgccacaataataaaaccatttgatcttgacaagataatggtgtcgttgacttttcttttttctttttcttttcttcctttttttgtttttgaaacggagttttgttcttgtcacccaggctggagtgcaatggctcaatctcggctcaatacaacctctgcctcccgggttccagcgattctcctgcctcagcctcccaagtagctgggattacaggcataggccaccatgcacagctaattttgtatttttggtagagacggggtttctccatattggtcaggctggtctcgaactcccgacctcagatgatccgcccgccttggcctcccaaagtgctgggattacaggcgtgagccaccgcacctggcaactttgcttttttcttgtccattggacaaaattggccaataatataattggactgttatgaccaataaaaacaaagtttaggtcaagtcttgtcaggatagcctcactaaaaagatctggctccttaatttaaaatagttcaggcaacaagattcttgctgtgttttatgttaggttaacatgctgaactttaggaagctgtagactgcagtttgttgttgtgagacctacagagtatagaaaaagggaacaattgagcacctttcatttttgaaaatgatgctttatgcggatgccaaagtaaataaatctggaagaagcagccatgttctttcattcacccttggcaagcgaatagaaaagaacgattaagaaatttttaacctataataataaaacttttcactgtacactaagcataatagctcactggaaaaagccaatatttaaaatatgtatgtatatatatttgtctaataaagattacaacattttcaggcaactggacaaatagagacatttacagaagcattaccattgtggtgaaaggtgcgtgtgtgtgtgtatgtgtgtgtttatttacacggatgaggggaatataaagggaaaaattatgctaaaacaaaagaaaaagcaattttaaaatcatatttttctattaaagtccagaaagtctcccagtttcacacagttttattcacaattttttttttttttgagacgaagtctcgcttttgtccccaggctgtagtgcaaaggcgcgatcttggctcactgcaacctctgcctcccagattcaagcgattctcctgcctcagcctcccgagtagctgggattacaggtgcctgccaccacacccggctaatttttgtactttttgtagagacgaggtttcaccatgttggccaggctggtcgcaaactcctgacctcaggtgatccgcccgcctcggcctcccaaagtgctgggattacaagtgtgagccaccaaggctggcctcacaacttttgtcagtaaaccaaattactgtacagttaccaggactaagtcaaaggactttatattgcaatagcagataaatttatattgcaatagcagataaatacagtattccaatagtttacaatttttaaatacattgtttcacgtggctgctagaataaattttttaccactatacatcgttaacattaaaaaattatattagctaacctgactttttggggggcaattttggattacgtaatcacaaggtacaataaaacagtgaccccaacatccagttctgattccagttaaaaatttagactaaagatatcacaatccgtaagaaaagaaagaatatggatggtataaatgatgaattataacaaagtgcagtaatgaaaacaatgtgcaaacaatgctggagatcataaattacaatgggaaaatatggcaaaggaaattctggaaacccataataaaatcaagtttcaataactggctagttatgtttcattctaccttaaatctggaaagcaatagaaattccctaaaaatgcaacagcaagttgtctttatacaattctttgcattgtaatttttttctttttttctttttttttttttttttgatttgtttgttttgagacagggtctcactctgtagcccagtctggagtgcagtggcacaatcatggctcactgcagcctcaacctccagggctcaggtgatcctcctacctcagcctcctgggtagctgggactacaggcacgtgccaccatgctcagctaattttttgtattttttgtagagatggggtttccccatgttgcccaggctggtctcaaactcctgggctcaagtgagctgcctgccttggcttctcaaagtgttgagatcacaggtgtgagccactgcacacagcctaatttgtttatttaagcagaattgagcaaacgtctccattcagctcccatgtgctttattgaaaattatgtcaacttcagtatattaaaaagctacataaaataaccaggtggcaagaagacatcctaagtggcccctacactatgcgggcccagcctaggtctcctttgctcctttaccaaattccctttgtcttgccacaggccccaggacctccaagcaacttcctctccttcatcagcagttgccagcagtcatcctctgggctctgccagcaagttggcagcagggtaggattcacaccccttggcttctacctcacagttaccaccaaaggcctttccaatttaaaaaagcaattttagaaattgaaccagaggaataaccaccatgtacaaatcaaaaagcatagaggggcttataatgagaagttgtgctcctctgtcctaccttaactccctctgaaatccaggctccctatgatcaatccccttgacctttcagttctctgggtagatttcttttcttttcttttctttctttctttctttttttttttttgagacagagtcttgctgttgcccaggttggagtgcagtggtgggatctcagctcactgcaacctcctcctcctgggttcaaatgattttcctgcctcagcctcccgagtagctgggattacaggtgcccacccttacgcctagctaatttttgtatttttagtagagacaaggttttaccatattggccaggctggtctggaactcctgacctaaccgcccacctcagcctcccaaaagtgctaggattacggacatgagccaccatgcctggtctgggtagattttttttcttttgagatggagtctcgttcttgtcgcccaggctgaagtgtagtggtgtggtctccactcactgcaacctccgcctcccacgttcaagtgattcttctgcctcagcctccagagtagctgggacttacaggcgtgcaccaccatgcctggctaatttttgtattattagtggagatggggtttcaccatgttggccagctggtctcgaactcctgacctcagatgatccacccgccttggccttcccaagtgctgggattacaggcataagccaccatgcccagcctgggtagctttcttatactgctctttcttgttttatcaactttcatttaagccctgtgatggcaaatgagagccaagctcacttaaccattttcccacctccatttttgagtcctagtcttttttgttttgttttgttctgttttgttttattttgttttttttttgttgttgttttaagatggagtcttgctctgtcacccaggctagagtgcagtggtgtgatctcagctcactgcaacctccacctcctgggttcaagcgattttccacctcagcctcctgagtagctgggattacaggcgctcaccactgcgaccggctaatttttgtatttttagtagagatgaggtttcaccatcttggccaggctggtctcaaactcctgacctcgtgatacacccgcctcggcctcccaaagtgctgagattacaggtgtgggccaccgcacctggctgagtccaagttttatttccctataatttaaaaattatatcattccatgctttgtctgtaggctgattctaaaagttgaaaaccaatgtcattatttttatttttattttttttgacacggaattttgctcttgtggcccaggctggagtgcaatggcatggttttggctcactgcaacctctgcctcctgggttcaagtgattctcctgcctcagcctcctgagtagctgggattacaggtgcctgccaccacgcctagctaatttttgtatttttagtacagatgggctttcaccatgttggtcaggctggtctcgaactcctgatctcaggtgatccacatgccttggcctcccaaagtgttgggattataggcataagccactgttcctggcccaatgtcattatttacattattacgacaatgtaaatatttttctctataccacctagtcctttgctaataaggcattcttttttttctttttttttttttttttgagacagagtctcgctctgtcgcctaggctggagtgcagtggcacaatcttggctcactgcaacctccacgtctcaggtttgagcaattcacttgcctcagcctcccaagtagcgaggattacaggtgcctaccacaatgcctggctaatttttgtatttttaatagagacgaggttttgccatgttgtccaggctggtcttgaactcccgacctcaggtgatccatccaccttggccctccaaagtgctgggattacaggcatgagccaccgcacctggccttttttttctttctttctttttttttttttttttttgagatagggtcttgttgtgtcgtccaggctggagtgtagttgcatgaacatggctcactgcagtatctgtctcctgggcttaatcctcccacctcagcctctggagtagctgggatcatgggtgcacatcaccatgcctggctaatttttgtattttgtaaagatggggtttcctcatgttgcccgggctggtctagaattcctgggctcaagcatcctcctgcctcagcctctcaatgtgttgggattacaggcatgaaccaccattcccagccaacaggccctcctacacaactttttgtttttagtggcgtttctaattgcctttcatttttatccctgacattctttggcttaatcatagccttatgtttttctgtcttaaacaaattatctaatgcatgagtcattgtcttgccctactgaccctctggggagtgctccattctcctgctaggatttggattgcttaccgcacagcctgctgtacaaatgtcaccttgagtcagagtaattctcattgctttccctgaacctcttgttttctgaacccaaataaataaaaatgtctggccaggcgcggtggctcacatctgtaatcccagcactttgggaggccagggcaggtggatcacttgccttgagaccagcttggccaacatggcaaaaccccatccctactaaaaacacaaaaattagccaggtgtggtggcaggcgcctgtaatcccagctacttgggaggctgaggcaggagaatcgcttgaacgcgggaagcggaggttgcagtgaggtgagattgcaccactgcactccagcctgggcaacagagtgagactctgtctcaaaaacacaaaacaacagaaaaatttctagcccagtgcagtggctcacggctgtaatcccagcactctgggaggccaaggttggcgggaggatcgcttgagctcagttcaagactagcttgggtcatatagcaagaccctgtccctaattaaaaatatatattattaaaaagaaaaaaatttgtttccttatttttgatagcacacttttttttttttttttttttcctgagcagagtctcactctgacacccaggctggagtgcagtggtgtgatcttggctcattgcagcctctgcctccctgtttcaagtgattctcatgcctcagcctcctgtgtggctgggactacaggcatgcgccactatgcccgcctaagtattgtatttttagtagggacgaggttttgccatgttggccaggatggtctcgaaatgctgacctcaaatgttccatccgtctttgccttccaaagtgctaggattacaggcataagccatttcgtgtctggccaatagcacacgcttttaaaaaatacctgccaagaaagggtaccctgagtccttacatgactgaaaatgtatttattctgactttacttgactgtttggctgcacatagacttctaggttgaaaatcattttttcttaaacttttagatttattcttccataatcttctagcactaaatgttgtagcggaaaaatctgacaccaatctaattcttgttttatagattgtctgttttatctaaaagtttcttttattcttaatgtttggaaattttatagtgatgtatgtaggagtgagtctttttccatttgtccacctggcttataatgtttatcaactgaccccttgctccccccacccctcatagagtgcaggggctttaatttattcactgctaaattccctgtatctggcacacatcaggttctcaatagtcatttgctgagtgaatgaatttattctgctagaatttaaagtcccgtgactcgcatcagctcagaaaatttttcttttattcttgtcttttttttttgagacagggtctcaatctgtgattcaggctggagagcggtggtgtaatcacagctcactgcagccttgaactcctgggcacaagtgatcacagctcactgcagccttgaactcctgggcacaagtgatcttcctgtcatagcctcctgagtagctaggactacaggtgcacgccactatgcctggttaatttttaaaatttttgtagagacatggtcttgttatgttggtaaggttgggaattttttcttcttcttttgtgagagtctcactgtcacccaggctggagtgcagtggtgtgatcttggcacactgcaacctctgcctcctgagttcaagcaattctcgtgcctcagccacctgagtagctgggattacaggtgtgcatcaccacacctggctaatttttgtatttttagtagagatggggttttgccatgttggccaggctggtctcaaactcctgacctcaggtgatccacccgcctcggcctcccaaagtgctgggattacaggcatgagccatcacgcctagcctagttttacagattttgtagtttcttgtttttggtctataacctgctgcctacttttcttgcttccttgcctatatatatattcatttattttttaattcctttgctgagaataaaaattggatactttagctgggcttgtccttcagtttttttgtttttgtttttgtttttttttgagacggagtctcgctctgtctcccaggctggagtgcagtggcgcaatctcggctcactgcaagctctgtctcccgggttcatgccattctcctgcctcagcctcccgagtagctgggactacaggcgtctgccaccacgcccgcctaattttttgttatttttagtagagacggggtttcaccgtgttagccaggatggtctcgatctcctgacttcgtgatccgccccactcggcctcccaaagtgctgggattacaggcgtgatccaccgcacctggcctcagttttttgtttgttttttttttttaaacaggcaagttcttgctgtgtcacccaggctggggtggagtggctcgatcatagttcactgcagcctcaaactcctgtactcaagtgattctcctgcctcagcctcccaagtagctgggactataggcactcatcaccaagcctggttaatttttttttttttttttggtagtagagacaaggtctcatactgtggcccaggctggtcttgaactcctggcttcaagctattctccccactcggcttcccaaagtactgggattacaggcataagtcaccttgcctggcctttcacttttattttaggtaaactgcttttaaaataccctcttagaaaccatcttccttgctacagaagagagaaagcaccccgtggcttttcctcaaaggaagatcactgtgggggctgggcgcggtggctcatgcctgttatcccagcattttgggaggccgaagcgagcggatcacctgaggtcaggagtttgagaccatcctggccaacacagtgaaacctcatctctactaaaactaccaaaattagtcgggtgtgatggcacgtgcctgtagtcccaactacgcgggaggctgaggcaggagaatcgcttgaacctgggaggcagaggttgtattgaggtgagatcacaccactgcactccagcctggcaacagggtgagactccatctcaaaaaaataaaataaaataaccgagtatgcacaattcaactgtaatagatactatcaatttaccctccaaagtgaccataccaatttatacccccaccagccttgctaaaagtattctaagatattaattttatggttaataaaatatacactgagacttctgaaaaaacttcaaattcaactcatgtgtacccacaggttccttaataacaccataataatctggtgcatcattagggtctactggttcaaggaaaggctgggccatcttatgggcctataatgaaaaagtaggcattcttattgtcagtgaaaacactaattccatttaagattcccagttgagtcactacatcaatgaacccaaaagtcagttttaaatgcgatacatgaaatactttatattaggtgatttctgctctagtaataagttacctaagatgagcttcctctgcaataatggtactcaaagcttggtcggaagaccttggtgtggtgaaggggtgggttgcccctccacacctgtgggtgtttctcgttaagtggaacgagagacttggaaaagaaaaagacacagagacaaagtacagacaaagaaataagggggcccagggtacctgcgttcagcatatggaggatgctgccggcctctgagttcccttcatatttattgatcattcttgggtgtttctcggagagggggatgtgtcagggtcataggataatagtggagagaaggtcagcagataaacacatgaacaaaggtctctgcatcatagacaaggtaaagaattaagtgctgtgctttagatacacatacacataaacatctcaatgccttacaaagcagtatggctgcccgcgtgtcccacctccagccctaaggcggtttttccctatctcagtagatggaacatacaatcgggttttataccgagacattccattgcccagggacgggcaggagacagatgccttcctcttgtctcaactgcaaagaggcattccttcctcttatactaatcctcctcagcacagaccctttaagggtgtcaggctgggggacggtcaggtctttcccttcccacgaggccatatttcagactatcacatggggagaaaccttggacaatacctggctttcctaggcagaggtccctgcggccttccgcagtgtttgtgtccctgggcacttgacattagggagtggtgatgactcttaaggagcatgctgccttcaagcatctgtttaacaaagcacatcttgcacagcccttaattcatttaaccctgagttgacacagcacatgtctcagagagcacggggttgggggtaaggttataaattaacagcatctcaaggcagaagaacttttcttagtacagaacaaaatggagtctcctatgtctacttctttctacacagacacagcaacaatctgatctctctttcttttccccacagtgtggggggtggaacacaagcttagaagtcacaaaatcagtattctgggccctacatgatgagctgtcactgagtgatgctggcattgcaactgcttctgtaacaggtgggatgggttcaaagtgtggaatcattaccacagctgattaatgatgaggtggcagagatgtgatgttagataacattcaaccacacattgagactacgattccctttttagtttcttcaattcttgtgattatgataaaaatagaagaaagtttcaatccaatgcactatatccttttatttccccccattgttttgagacagggtctcgctctgtcatccaggctggagtggagtggcacgatcatagctcactgtagcctcctgtgctcaagtgatcctctcacctcagcctcccaagtagctggataaacaagtgtgtgccaacatgcccagctaattttttatttttattttttgtagagatggggtctcactttgttgcccagattggtctctaactaattgactcaagtgatcctcctgccttggcctcccaaagtgctgggattataggtgtgagcaaccacactggccttctgtgtcttcaatacacctgtatcacttgctaatcctgcaaaccatacctatcctggttttcttttctttcctttttttttttttttttgagacagagtctcacactgtcacccgagctggagtgccatggctcgatcttggctcactgcaacctctgcttcctgtgttcaagcgattctcctgcctcagcctccctagtagctgggattacaggctcacgccaccacacccgactagttttttgtatttttagtagagacggggtttcaccatgttggccagtctggtctcaaactcctgacctcatgatttgcccacctcagcccccacaaagtgctgggattacaggtgtgagcccccgtacccagccacctttctgtctttcataaggaaaataataactataatctaatcatactgtttctcaatccatgggagtgagaggaagtttctttaaaaataaaatgtataaagaagtgagtcacgttagattatctgagtgttagataagctgaggtggtgtggggatatggtaaagctcatgacactggtatgtgaaggactgaagtttgtcaagcccttcactagactagctgagagtcagtaaataatcactctaagattggaaacttgaaatcctaacattggaaacttgaaatcctagaaatgcttccaaaattatgccagctgatttcattttcaaatgctgcacacagaggggctctcatctgtaaggaacggagcaccctcttcaactcctcatcatccttctctgttagtggtgtgagcactgtcatgacatcctctgttgactggcactgtggacagacatactcatcaatgagctctgcctcactctgcaagatgccaatgcagcacccatggtaccaattctgacaccgatcatggccaataaaaaatctgcaagatccgaaatggaaatgtgagttcaaaacagatgggatgatgttacttataataaagcatgcacctgaaaatttgctaaaccctgggatataaaatagttttagtattgtggttttaatactttcaagatcgacattccagtacattaatttagtatttttgatgttaagaacaagcagtaaaaaaatttataagaacactgtaattttggagaaccaatttaaagataaatatgaaacattcaattgattttaaagctgaaaacaagtcacaaatctttcaactagtactgtaccatgtgggagttcaaaatcctataaggtaataacagagtctcaaagcttatacccaaattagtgtttttctaacctataataaagcaccatttcaaacactgataaagtccaaacaagtcaagctagtttaatctcattaatttctatgttacatattgaagaatcaaatctaccattaaaccacattttccccaatgtgtctcaaacattcactatgaagcaagataaattttgaagggtaggtaaaaagggaaaaagagaaaaaaaaatgaaaaggaatttgtaatgtaagtgtataacaaatgtagaaaaaatctgctttttattttaaagtaaataagtaaccagtcagagcaatttggcttcctaaattattaaatgtgatgctcttattagaactcactgtgactgcaggtgttctgcagatacagtacaattcctcactgctgccctcttgtgcccatttacaatcattacagatgtacacatccattttcttagcctccttttctgcgatgccaacacattctccataatagcagttagtacaaagatcacagccaatatagaacctagaagtattcacaacgaaaatgacaatgtaattgtcgttttgagctgcatggtacttaaatctgtcttccctgccttgcttcatttttttacaggataacttcctgctatgagtcagctaaacattcctgaatccaaccattctacccctggcaaactccagtatctgatgctctatcacatgtgcaaacaaagtcactcacatgggtttcaacaagtacactgcttagtgaaatatgggtctttaaaaacatactggaatttgaaaaaataaaccacacactgatggtaatgtcttcctctgaatgaatgtgtgcaaaactgtaacaggcacaaaaaccaaagccaaagaatcaaagacttacacctgtcaaacctattccacagaagccatttcaatatcagggctatttcttagataggtttaaaaatgtatctcacaatttaaatttgaaaacaaagcaaagcgcaaacaccaagtagaagttacactacaaggaccatgcaggtcagccaggtgtagaagataaacggtcaaaatatgctaagaagaagaaaactaagaaaggtacatagagcaattcaatctctaccaggttttctgaataaacattggaatttaatcgaattaaaaataatttctcataatggaatatggcatgggccactttttcagttaatataatgtttgtgacaatgtgggcagtggcctggctagttaacgggtagggaacgtggaaggagctgcttcagttcaacatcggggacatggtatggggaaggatgcaaagatagttatccagaatctgtctacactgcttggcagggtctacactgcttggcaaggcggagctgtgtaagtgtgtgattgtggagtgcacagtggcctctgtaataaaagacgtaatgacaaaagaaaaagtaaatgtaacaaacgcttatacagtgtgtctacaagtgttgataggcacagtgtaggaacatcatgtcaaagtcatagtgagaattaccatgaatcacagggaagcaggctggctttgccgataccattggcactcctagctctaccaaggcatttcttggtagattcacctagaggaatggaagtcgtcctcaagcttcaaattgacctgcttcatgaatgtgaaggaataatacatggctatgtagtttatcctgttaccactaacttttttcttttgtctcgctgtataacccaggctgcagggcaggggcaggatcacggccccctgcagcctggacctcccaggctcacatgatcctcccacctcagcctcccgagtagctgggactacagatgtgcaccaccaggcccggctttttttttttttttttttttttgacggagccttgctctgtctcccaggctggagtacagtggcatgatctcggctcactgcaacctctgtctcctggcttcaagcaattctcttgcctcagcttcccaagtagctgggattacaggtgtgtgccaccacatctggctaatttttgcatttttggttgtgccacgttggccaggctggtctcaaactcctgacttcaggcgatccacctgccttggcctcccaaagtcctgagattacaggtgtgagccacagggcccagcctcttttcatattttttaaaaaaagttttaatgagcagtgaggacgaccagaggtcactttcgtcaccatcttggttttggtcggcttctttactgcatcttgttttttctttttttttttttttgagactgggtctcactctgtcacccaggttagagtgcagtggcacaatctcggctcagtgtaccctgcacctcccaggctcaagtgatcctcccacctcagcctcccaagtacctaggaccacaggcacgtgccaccaagctcagctaattttttgtatttttgttagagacagggtttcaccatgttggccaggctagccttgaactcctgacctcaggtgacccatctcagcctcccaaagtgctgggattacaagcgtgagtctctgtgtctggccaacatactattgtctcaatatgcattttgccatactttttaagtgcatctcttctgctatcctgtagtacaacttactcttggaaatgatcaaagcaaactatattaccctagggacaaacccattgtgattggcatccacgaacaaatttggtgtaaagaaatcatatctatgaccaagagggtttctttcttatttggagataagagtctcactttgtcaccctgcctggactgcagtgacataaacacggcttgctatagccttgacctgccaggctcaagtgatcctcctgcctcaaccccttcaaatagctacaggtgctcaccaccatgcccagctacttttttttttgtagagatggagtcttgctgtgttgcccaggtaacttacctcctgagctcaagtgatctgcctgcctttgcctcccaaagtgctgggatgacagttatgagccacttgtacccagccataagaatatttcttaaaatctgacttaaaatttttttaaaaaattcttttagagatagggtttcaccatgttggctaggctggtctcgaactcctgacctcaggtggtctgcccaccttggcctcccaaagtgcttggattacaagtgtgagccactgtgcccagccaaaatctgacacatttataaatttctacaataattttaaataccaaaaatattcccaaaacgtttcatcatgattatttttcttcctaaatcttatagtctctcagaaaaataacttagcccacgtttcctttaaagagtttttaatttttttaatgaagggccgaattaattttatttttccttctttgaaaaaattcatccagcacactggctcacacctgtaatcccagcagtttgggaggccgagggcggaagatcacttgcgtccaggagctcaagagcagcctggccacatggtgaaaccccatctctactaaaaatacaaaaatgagccaggtgtggtggcgcatgcctgtagtgccaactacttggaaggctgaggttggaggctcctttaagcctgagaggtgaagacttcagtgagctgtgatggcaccactgtgctgcaatgtagatgacaaagtgagaccctgtcttaaaacaaaacaaaacaaaacttttttttggagacagggcctcacttgatcgccccggctagagtacagtggtgctatcatggctcactgcagggtcgacctcctggggtcaagcagtcccctggcctcagcctcgccaagtagctgagactacaggtgtgcatcacaacacccagcaaattcctttttgtagaaacagggttttgccatgttgcccaggctggtctcaaaatcctggcctcaagtgatccacccacctcagccttttagaatgctgggattacaggctgtgagccacaactctcttggcctataaatgataatttaagtgaatctctgaagctacagttttttgtttcgagatggagtctcgctctgtcgtgcagtggcatgatctcggctcactgcaacctccgccttctgggttcaagtgattctcctccctcagcctcccaggcagctgggattacaggtgcctgccaccatgcctggctaatttttgcatttttagtacagacggggtttcgccctgttagccaggctggtctcgaactcctgacctcaagtgatcgtttcacctcagcctcccaaagtgctgggattataggcatgagccattgcgcccagcctctgaagctatagttttatagattctaaagcagagacttcatatagatgtctatgaaaagccaaaaacaaacaaaaaacccacaggaaaacctgattccccacgccaaaatttcaaggatttgcctaaaggtaaggtccatctgtacctgaaataagtttgctgtgcctctttttctgcagggtaacccagccctatgcaccaatcattacatgactacctcaggaagcttttaaatatatcacaaatattttaccaaataaacctgaatggccctggtttaatgaatctgcttctctgtctatagactatctagtctcataaagtcaaaagagaagcaatgtgacaaattattcaacagcccttctctatttatagagagagactgaacttcttctttggttagaaagaaaaccttgagtttcatttcctagttcatatatttttataacatcgtgggacggattttgggagaaccaagatggtatagcgggtgcacactttgatcctccctctcccttcaagaacatacaagtgagagtaaaatataaaaaagagaaattgaaaagacatagtcatgcttaaataagttacaacaatctcaatggaacagacacaaaactgtgagcaggactaaaactgcaggccttctagactccagatgcagaaggaggaagtggtggctgaacactaacagtaagagtttctcgggggtaagggaggctaacatgctgtgtgtgaggcagtgataggctccctgctggaagttaagggttgactgggctacactgggcttcaggagagaagaaaacaacactcctctcactcaaaataagcttgcaaaattcaaatgtttgaaaatgaaaatgtgtaatatgaaaaaaagacaaccagggcccatacggtggctcatgcctataatcccagcactttgggaagtcgaggaaggaggatcacttgcttgagcccgggagtttgagaccagcctgggcaacatggcaaaaccttgtctctacaaaaaaacaatgacaacaacaataacaacaaaaaacaccccaaaattagccagagatggtggcatggcacgcgcctgtagtcccagatacttgggaacctgaggcggaaggacttactgatctgggtagggggaggctgcgatggggtgtgattgcaccgctgcactccagcctaggaaaaagaataaggccctgcttctcaaaaagcaaaaaaaaaaaaaaaaaagccaataaaatcaatggtctaatctgaattcactccaaatgaaattatagagcaatttgacaggccaggcccagtggctcacacctgcaatcccagcactttgagaggctgaggagggaggatcacttgaggtcaggagttcaagaccagcttggctaacatggtgaaaccccgtctctactaaaaatacaaaaattggctgggtgtggtggtgggcacctgtaatcccagctacttgggaaactgaggcatgaaaaccacttgaacccaggaggcggaggttgcagtgagccgagatcatgccactgcattccagcctgggtgacagagcaagacactctctcgaggaaaaaaaaaaaaaagaaaaggaaaacaactcaagggttggataacattgccagtataaccataattcaaaacaagcagcagaatttggaggataatttgtttcattctcaggaaaatgtgaaactctgaaactgctttttgagtgcagggtatttccggggcttttcctaaagtcttaacccttggctctgaccccttatttgaagtttggagagcagaaccgaggattgtattactacagttgtggacacaggagaggggttagtctccccccgctccaggagtaagggatgctgggctgctcgaacacaggccttgttagaactcccttcaaacaggatcccagagatgtggggagaaggtaactggccttaagaatgattgcgctacagctttcgaaaactataatgcctttcaaatatggcttattgcttggatctcaatatctcccacgtatcttgggtggaatattttgccgaagatctttctgtcaatcatttacaatcatgtgctgcaaaatgaagtttgggtcaacagtagaccacatatatgatggtggttctgtaagcgtataatggagctatccctatataggtataccatttttatcttttttttttttttttttttttttttgagatggagtctcgctctgttgtccaggctggagtgcagtggtatgatcccagctcattgcaacctccacctcccaggttcaagtgattctcctacctcagcctcctgagtagctgggattatagacacgcgtcaccacactcagctaatttttgtatttttagtagagatggggtttcatcatgttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaatcacctagtgacacatttctcaagctcctcacgtggcaagcaatgcatgactgcatatgaaagctcttaaatagagattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataacgatagctccatccctaaatgaggtgaatcttggactctcttccattttattttattttatttttttgagatggagtttctctcttgttgcccaggctgaagtgcaatgttgcgatctcggctcactgcaacctctgcctcccaggttcaagtgattctcctgctttggcctcctgagtagctgggattgcaggtatgcaccaccacacctggctaattttgtatttttagtagagacggagtttcaccatgttggtcaggctggtctcgaacttctgacctcagtgatccccccacctcggcctcccaaagttctgggattatgggtgtgagccaccacacccggccccccttcaattttaaagccatcactatgcaccctatgtctatgccaagcactaaaataagatgaagcaccttcttggagtttacatgctggtaattatgccagacagtaataaaataggtaagaacggctgtgggggaagtcagctgggttctagttacagtcgcatttcaggaaatgatttaacatgctgactttaacaacctaagcctcttctccatgtgtgcacacagggtagatctctgaacacaggtgaccctagaagtgctgtaacttctaggggaatggctgtgttgagtcaaggcaggatgacagttcagcctcctcccaggctagtgcaaagggctcttcactcggattaaaaccttctctcccagaccgaattgccaactcccaacacccctcctacagaaaatttggagtcctcgcttattccctggcagcccctacctaatagggtggtgaattaattatcaaacatgcgacagtttagcgaaaatggcaacactttggaataagtgactgtaatgtgcatcctggcgcccattttgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccaccccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtgacataaataaaggtgtcataaagacagggcggggctcacgcttagaaggggcacgagcgtctcggagctgccagaatgtcttctgctcagtgcccggcactagtgtgtgtcatgtcccggctgcgtttctggggcccatggcccctccttatgtggcaactattgtggctactagtcaaggaggctcagcctctggagtgggtcaaggacccgctccagctcacctctaatcccctggggccgcctgagtcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaaggctccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactggacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcaatgatgatgctctaagtcgttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttaccatatgtaggagagttggctgttcacatgattattcagtcctttagttttgtccagaactcatttttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggcgggcggatcatgaggtcaggagatcaagaccatcctggctaacatggtgaaaccccatctctactaaaaatacagaaaaaaattagtcaggcatggtggtgggtgcctggagtcccagctactcgggaggctgaggcaggagaatggcgtgaacctgggaggcagagcttgcagtgagccgagattgcaccactgcactccagcctgggcgacagagcaagactccatctcaaaaaaaaaaaaaaaaaaaaaatgataggagggaagaaagagaataggcataaaaagggaggtatatataattaagtactaaaagataatgcagaccattggtgctagaatttgccagaatctgtgatccttgaggtgtggagatgctacatgggtaagctaaaactttacttgggtcttaaagagtagctataatttgttaaatagaagaaaaatgggagtacagtctaggcaaacgcatggctacaggtatggttggaatttagtagaccaatgtggctacaaagaattaggtgagggagcaatgaagatacgattctgtaaaaccttgattatcagctataggagtttgaaagttacacagtgaggtatggaaagccattgaaagtttccaagcaagagagattacatgatcaaaacaggaagattattttattttgttttttgcattatgtgcaagtgtagacatgcagaggattgttttagaatccatatgtaaagtgtccaaaaggaaaagcttaattcagggagacaaaatagaaaggtctagcaaaatctaggagtgaagtgtgaaggggccaaatcagatcagttgtaataggagtggaaagaaaaagcctaggatgtttcaacagagggcactgggccaaagctttggtgttacctggcatagggtttctttcttctcatttgttgataatgataagcttttgcccatatttctgtggaattatttaccattttggtactgatttgtagaagtctgtttagacacataagtgcttttagataaaatacttacattcaaagtaattaactggcatcatctgtccaagagatgggatggataagaagttaagcttccaggagatgcctcatcatttgtgccagtgaccccgcataatttcttgatgaattgtgcaaactgggaagctgatagctctggaaatgagaaagcaggtgttattttctgtttctgaatatccccaacaaggttgcaatgattcttttacttatcgtgttcattgttttcctacctattcaaggatataaactgtgtttcttcacagaaatttccaaggaaactatatttcttacattgatggaaatgtatggaaagcatacagttggactgagaaactgtgagtatattctctccaaatatgacaaaaagctaactgcattgtaagatccttcttggtccagaattttgaggtcggtacctctgaggaaagatatttctcctccatgccccaaatcaaccactgttgattgcaattgtatggtcattttaaaattaaatttggtaggctctctttaaaataagaggcaatttaaatttattttttatcatacaaatagtacatggttatattcctttttgttctcttttttgttttttttttcagagacagggtcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtattttttgtagagacagggtcttcctatgctgcttaggctggtcttgaactcctgggctcaagtgatcctcccaccttggcctcttaaagtgttcatattacaggcatgagccaccacccgcagcccatgattccatttttaatatataaaaatgcaataacagatataacaaaaactctccttgtgccctactccctcatccctgaagtaatgctactctgcatttagtatacatgcttccagacttttcctcatttacctacatacatatttacataaagcaaaatagatttgttttgtggttttaaaattttttcttcgcataaagggtaacatcttgcaacttgattctttcacttcatgatatgccttagatttctttccttcccagtacttagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctggaaatggaattcttggggtgaagactatgtagatataaaattttaattgccttcaaaaattttgtgccaacttactctattgtcagcagaatatgacagcattcatttcccaacaccttttcaccgctgggtattctccaacattttgctgaagttatggatgaataaaagggattccatctaaatgtgaatttttctgattactcatgaatttaatttagtatctttatatgtttattgaacatttgtgtttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattatttcaatgtatatagacaagccacgatgagttctaaattaaaaataaacatatgctaggcgcggtggctcacgcctttaatcccagcaccttgggaggtaggcggatcacctgaggtcaggagtttgagaccagcctggccgatagggcgaaaccccatctctactaaaaatacaaaaagtagccaggcgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagcgattctcctgcctcagcctcctgggtagctggaattacaggtgccctccatcacacccagctaatttttatatttttagtagagacagggtttcaccatgttggccaggctggtctcaaactcatgaccgtgggtgattcacccaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggcatgctagcaatgatcttttgtaaggatgtttacatgggtatctgcttcataattattaaactgaatattttggccaggtgaggtggctcatgtctgcagtcacagcactttgggaagcagacacaggaggatcacttgagccaggagtttgagaccagtctgggaacagagtgagaccctgtctcaaaaattaaattaaattaaatataaacaacatttatgttatgtgcactttatgcacattatagttctccaatttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataatagaatttggtgggaagaaacccactcttcaaggggtgtgcttgagtgtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtaaaatgaataaggggttcaaattagataatctctcagatttctttgagcaataaaattctgcaattctgtaagtttgtatagggtctcagcccatctctaacactagctacctcctgtgcattttcagtttttaagttatatagacaaaatacagacaaaaacatttcacatggtaagaaaatctgagcagtgactgacacccatatgaaccttgttttataagggttcacatatcattctttttctattcagtctacaaccaatagatctaatctaatttatggtctatttttaaatagcccattaagttaagaatgggttttgcatttttaaagggactgtgaaagaaaaagaaaagaaacaaagaaatatgcgagagatcatatgtggcccataaaacctaaaatatttactgtctgaccttcaccaaaaaaaatttcaaaaagttggtttagtaggatgaaaggaactaaagttaacttcagatggttgcctaaaggagaagaaaatggagaccacctgcattcatttgaacatcattaatccagaattttttggtaatttaatcggaattaaattaacatttaaatattaaaaatagctgaattatatcaataatattatcaagaatattaagctaccaagagaatagactggtattaaggatttcatttcaggaattgttatattaaaacagatgtttaaaatgatggttaactgatagagctagaaatgtttacactaagaagcacatcagaaatgcccctaactcttcactaattacaaaataacgatcgccccagccctgttaccagaaagggatccctgtatttctgtctgtttagagacaagaagatactatgttcattgctatgaaagcttgattcttaccctttgtccatagaggtctgtatgtcattaatccttattaagctcattagtgatgctcttttgcaaacagattctttcaaatatagaaggcttaaggaaagtgggtgtaaagaccctcaggtggatgccaaagtgctacagagaccatgaaataataaaactacatttcctttaaaatagttattttccttctactcactcccccagctattcatttattttacaaatatttgagtttgctttatttccatgtgtcagttttaaacatggtgggcaatgcagatgagcaagacctagtccatgctttcagggagtttatgctcagaagaaatgggataaaaaataactacattaagaagaagaaatggatgtgggcactaggagggataaattgtttctcgaacatagaagaggaaaaaatgccttcaatttggacccaggaggatgttactagaacaatgccatttgaataggactttgaagggccattgtgtaacatcagacagacatcttggggaaaatactctaaacttgcaaaaggaaaatgggagggcaaaacacaggaaagtattcaaggaatgccatgagtacccgtagagtacaagaagggagagtaggaaaatggagccagatcttctagagctttgaatgccaagctgaggagccaacatggggaaccgtgttaccacagcagcgctgtaaggtagatctgcatcacagtcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactggagatggagatatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagtgcagtggtgcgatctcggctcactgcaaggtccgcctcctgggttcatgccattctcctgcctcagcctcctgagcagctaggactacaggcacgtgccactaggcccggctaattttttattttttttgtagagacagggtttcaccgtgttagccaggatggtctcgatatcctgacctcaggatctgccagcctcggcctccgaaagtgctggattacaggcctgagccaccgcacccggcccgactattttttttaatattagaaattgtgtatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggcagggttaggggctctggaatgttcaaatacaagtccaaacgtttagagttgagatgaaaaataggtattcagtattattctaaactcttgctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctctttgctattcttgaaatatgattaaaattttaccagtagaaagctactaaaattatacagcaaatcctttttgtctctagcaaggattattgtgagaattattacacagatcttagtgaatcatcagagagcagtggttctcaggtggtgtgattttgcactcaggtggcatttggtaatgtccggagacagttttggttgacaaaactgtgagtgtgctcctggcatctggtgggcaaaggccagatatgctgctaaacatccttcaaggtataagacaaacccccatggcaaagagttatatagtccaaaatgttgatggcactgaagttgtgaaatcctgttctagagaaataaagatcacttaacacaggtatttactgaacattcactgttttgtatctaatgcaccacgtgtgcagtgttaaagtataaatcataagccagtatcttccacagtcagatttccttagtgcatagagaaaggattgaggttatgttccatcctatataaattagaatcatggcaaatgataaatgttctgaaataattttttttttctttggcttgtgtcttttttttttagaaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcatgtcttaagatccattcatttttctcaaatggggaagctaaggtacaaagaggccaagagacttatgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaattagctgggcgtggtggtgcagttttttgctccctggaggactttgtgttaagcttccttccttgcagctaaatgttgcagacatctaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcaaaacctcatctctactaaaaatacaaaaattagcaggtcatggtggcgggcacctgtgatcctagctatcgggaggctgaggcacgagaatggcttgaacccgggaggtggaagttgcagtgagccgagattgtgccactaccctccaacctcccctccaggctggtctcgaactcctgtgacctcaggtgatccgcccacctcagcctcccaaagtgctggggttacaggtgtgagccaccatgcctggccaagatggtgtttatgttaagctattgtgcaaaaaaaaacttttgtaaagaaaatatatcactgtatcttaattccatatactttcctgactactcttctaccataattgcaaaaattctatgatttctctgtataacatacccatcaaatcagagtgggtatattcagtggcctgaaggggactcaaggtgaagattctcctctacatctgactttagaaaagactttccacctgccttgtggttcagaaatctagtttcacacagttcatttcaagttagagggaggcattcaggatgtgtctggactagagcagcagtttctgcacatgctcccctctgtcctcattaatttgctgatgcataacttaggaaaagtacactaaaggtctgtttttcttttgccctcacaccagagaacaggctcattaggtccctccaccaagaggtttaggtagcatcaatacaaatgttttaaactcaccatctttactaagcactttataccactgggagtccctcataaaaatctggtggccgggagcggtggctcatgcctgtaattccagcactttgctgaggtgggtggatcacctgaggtcaggagttcaagaccagcctgaccaacatggtgaaacctgtctctactaaaaatacaaaaattaggtgggcatggtgacaggcaactgtaatcctaggtactcaggaggctgaggcaggagaatcacttgaaaccaggaggcggaggttgcagagagccgagatggcaccattgcactccagcctgagggacagagtgagactctgtctcaaataataataataatataataataataatcatcatcatcatctagccagcttcactacaattatgtaggcaacaccaggaaaacactggaatcacagttgataaaaattaatgaattcactcaaaaacattcagagtgtcatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggctccgttggagtcaaatcttcctggtaaacaaagctacactgcagtcatatttggcatatgtgacatataggcccactgcatttccttccaaaggcaagatgccaagggaaggtgccagtaattttatgaccaaaatgacaccattttgtggtgtttgtaagttgaaacaatatatttccctgcattacacaagtttataaaaaacaaacaaaaaaagaggccccagctgtggttgatcgatgatgaattgaatagagcctaaccttccaggcttctcacttgcacaggcccttccaaggtcctgggagggcccctggaaatttttgtagtcataatttttttaatgtttttactagataaggctcaggccccacaaaatcctgaaatcatccctgggttccaatagttacaacccagtaaatctcttgaatgaagcctctatgttattgacaaatactgactggccaagttagcagggttaaaaggtctgtctattttgaatctgaaatccatctcaaagacaggccaagagcttattagtggacttaactggattctgctggcccaagcgcagtaaagtcaaacaaccatatcgaggttttgcattggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcacatattggcttgtctatggcacatcgatatcatgccaagaatgtaagcactaagagagaataagaggaaaatccaggctttatccctattgaattatttatcccactattagaatattagtgaggtaggtgtggccacactgtgatggcaaattgagcttcggtcacaaacatgccttactgttccccccagtctactgacatcagcttcctttacatagcggtagatgcacaaaagtttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcatcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgtagatgaggaagttgaaactcagagacgctaggtaatttgctaaggttcacatggctaataagtggcagaaccacttacaagctttgcaaataattttcaatgcagctcttagttcccctgtaataggagctgaatgatgacaatttggctttgtgtgcattgtgtcttactttctaacttgaataggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaacgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaaaaaggaaaaaggctcaccatttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatagtgggtgagggtctaggtcatctgcttatttctttgactaccttcttccatggaaccagttttccctgacagccttgggattctagcatagatcattttggagtttgtcatttaaatttattttcacggcctgctttggacattttttcagctagagctgttaggatttcagtacatttaagacagtgatgacatgctccagtcctttcatctctgtctcctcagttaatagaaaggaaacatagctcatctatctggacctgtacagaagaatttggagggaaaaaaaaaaacaggcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctgaaaaaaagcttgccacattttacttccataaagataccaaaaaggcgatggactgggagtcagtgcaccttagtttaatgtataaaatgaaggacttgaaccagaaatggaaatggtcatctactgtgaatctaaaaacactcgaggctgggcgcgctggctcatgcctgtaatcccagcaatttaggaggccaagacaggcagatcgcttgagcccctggagttcaagttcagcctgggcaacaaagtgagaccccaatctctacaaaaagacttttaaaaagtggaaacataaatataaataaataaaaacattcatatcatttggtttgtggaaaagagttgctgtagagtcctcaaacttgagccgttgagccagttctcactcagtctctccatggcccaggcacaaccttagtcaagaaaagaatgccttagaacaggaggaaaagaggataatatcgaatggccctatattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgccaagttgtttggctacatactgccttacagtcattatttttggtgtttagaaaaaaatagaaacagggtctcactttgttacccaggctggtctcaaactcctgggctcaagctctccttctgctttggcctcccaaagtgctgagattacaggcttgagatgctgtgcccagcctacattcatttttaatagctgggaggaaagtgggcagaggaagatatagaatgaaggggtagccgactttgtacagagcccaccagtggtcttacaagttttcatgccaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaagaggagggggatcacaaggcaggacaagctgtgtggctcccagcctcgccactgactcactctgatcttggtcaagggagagtgaatcttcactcctcttttttccatctgccagcatgtttggtcttctggcacctggtgttctatacagtacaacatgcttctttgtgttacattgagacttgatccacgtaccatcaacgcagtattataaagtgtacaattcagtggtggttagtatattctcaaggttgtatagcaaacaatcaccattatctaaccccagaacattttcatcatcccaaaaagaaacatggtacccattagccatcactccccagtgctgtcttcccgcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatgtggttgtttctactttattttggcttttatgaataatgctgctatggacatgcatgtactactttttgcgtggacatgtttttaattctagggtgcatccctagcagaattgctagatcgtatggcaactcttatgtttaactttttgaggacctgtcaggctgatttccacagtggctgctccattttacacttccatctgcaatgtttgagggtttcaatttctccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatataacttctttgaagaaatatttattcacatcctctgcccatttaaaaaattgatttgtctttttattgaattataggaatttctttatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgaaatttactcccatgtttttgtgtaagagtcttatcgttttggctcttacatttaggtatttgacatattttgcatcaattcttataatcgtgtgagatgtagggggtccaccttcattattttgcacatagatgttcaggtgacgccattgcactcaagcctgggcaacagagtgagactccaatggagacggggtttcagcacgtttatccgtttatcaggctgctctcgaactcctaacctcagatgatccacctgcttcagcctcccaaaatgctgggattacaggcatgagctaccatgcccagccaataaatgaaaactttttcactcaaaaaaacaacaattgtagtgaaaccatagatcagtttggagaatcatgctattattatctgcttcatgtttacagaatactccgttgaatttggtttgccagattttgtcaagcatttttccatctacattcgtaagaaatactggtctgtaattttttgtgtgtgatgtctttagtttggataccaggttaatatcaccctcatagaataagttaggaaatgttctctcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctatttatgtctctaagaacaatagtaatgtcccctctcatttctagttttaataatttggtcttctgtatttttgcagtgcagtggctcatacctgtcatcctagcactttgggaggctgcggtgggaggattgcttgaccccaggagttcaaggccagccagggcaacatactgagagcttatctctacaaaaaaaatttaaaagttagctgaacgtggtggcacatgcctgtagtcacagctactcaggtggctaaggcaggaggatcacttgagcccgggagatcggtgctgcagtgagccatgattgttccactgcactccagcctgggaaacagagtgaaaacctgtcttgaaaaatgaacagtaagaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttagccgagtgtggtggtgcgcacctgtagtctcagctacatcttaattttataacgttgtagttcagattaattccaactttgtttcaatggtatacaaaaactttgcttctctaaagctccactctcaccccctcctttatactgttattgtcacacattacatctttatataccttatgttcatcaactagatttataattattgcattatgtaagtatctttttcttttttttttttctttattttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccagccagtgctttttatttctttgtgcagattcacgttagtactccttatagggcaggtcttctagcaacaaagtctctcagtttttatttatctagaatatcttaatttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgcagtggtgcaaccactcacaacgttgcagcctccacctcccaggcttaagcaatgctgtcacctcagcctcctgggtagctgagactacaggcatgcaccaccatgcccagttttttttgtttttgttttttttaatttttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgactcttaacgagcatgctgccttcaagcatctgtttaacaaagcacatcttgcaccgcccttaatccattcaaccctgagtggacacagcacatgtttcagagagcactgggttgggggtaaggtcatagatcaacagcatcccaaggcagaagaatttttcttagtacagaacaaaatggagtcttctatgtctacttctttctacacagacacagcaacaatctgatttctgtatctttttcccacatttcccccttttctattcaacaaaaccgccattgtcatcatggcccgttctcaatgagctgttgggtacacctcccagatggggtggcggccgggcagaggcgctcctcacatcccagacgggcatgcccagttagttttaaattttttgtagagacagggttttactctattgccagtgctggtatccaactcctggcttcaagcaattcttgagcctcaagcctcccaaggtactgggagtacaggtgtgagcaaccatgtccagcacctgcattgtttttgaagacaaattagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccatcatttcttcaaatattctttctccttttttctgtttttcttctcctgggacgctcattatgtgtatgttagtaagcttgatgatgtgttccacaaacaggtctctgagattccattcactttcattcatttttatttctgttcctcagagtcaacaatctcaattaaccttcaagttccccattctgtcttcagcctgctgtaatgtgccattgagaacctctaataatttttccatttcagttaccatacttttcaactctagaatttctatttgactcctttttatggtttctatctctttattgatattctctatttgatgagacattgctttcatactttcctttagttctctagtctacagaactgaatcgtttctcttatctctttgaacatattttaaatagctgaattaaatccttctctaggccaggcatggtcgctcgtgcctataatcccagcactttgggaggctgagactgaggttgaggctgaggccaggagttcaagaccaccctgggtaacttcgcaagaccccacctataaaaaataaaaaaatctttgtctagtaagtctaacatctggtccttctcagggacaatttctgcttatttctcccccaaccacgtgtttgggccatactttgtttccttgcatctttcataaatgtttgttaaaaattgaatattttaaataatataatgtagcaattctgaaaatcagatccatgctgccagggtttggtgttactcctgcttgtgttagtagttgctatttatttagtgacttttctgaacttcttctgtaaagtctcgcattatatgtcatgtgttcccactaaagtccctcctcggttagcttaccgatcaggtaatgattaaatgaagatttacttaaattcttggaactgataagtctcctggtttttgccaaggggctctgtgtacatgttggggcataccttcagcactcagctagacaatttacagccatgccttagctttcacttcttgcttgtgcagaacctcaaggtgtcagccagggatgagagtttatgaacttagtaggtctttcctgaccatgctgacagtctgccctatgcatgcgcgtgacattccaaattgccaggaatatgtcttatggacttctagtttcccaagcatatatcagagtgtttcaaattcctgtggacatcttattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctggttggggatgtgggctgttttccaaggcgactactgagctagagggtgaggaatggtctaaggcaagttaacacaaatctcactgttcttacagaaatttttcttgaataaatgctccttgggttgctgcaagactttggttacatttctagagttctgaaaaagtttattgtggtcaattttttttttttttttttttttttttttttttttgctattttttttggtatttgttgcttttatgaagggatgaatttttggatgtctcttttttttttttttttttttttgagacagagtctcactctgttgtccaggctggagtgtagtggcataatctcatctcactgcaagctccacctcccgggttcacacaattctcctgcctcagcctcccgagtagctgggactacaggcgcctgccaccacgcccagctaatttttgtatatttagtacagacggggtttcgctttgttagccaggatggtctcgatcccctgacctcgtgatccgcctgcctcagcctcccaaagtgctaggattacaggtgtgagccactgcgcccagcctgcatgtctttattccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgttctccagcctgggcaacacagtgagtgagaatgtgtctcttaaaaaaaaaaaaaaagtctcattgaccatagactaataaactatttaatcatgggaaatgattaggggaaagacataaaaagagaaactgtaatccacttttttttgctctgttgcccaggctggagtagagtggcttgatcttggctcactgcaacctccgcctcctgggttcaagcaattctcctgcctcagcctctgaaacagctggaattacaggcaagcactgccgtgccctgctaatgagaaattgtaattctcatagaggtcctcccagaggagtagaagaaggttgaaaggcacttctgtatttagtcttctcacaattaaggctgggcccagtggctcacaccagcactttgggaggccaaggcaggcggatcacttgagatcaggagttcaagaccagcctggcaaacatggtgaaactcccatctctactaaaaacacaaaaaatagccaggcgtggtggtgcgtgcctatagtcccagctatttgggagactgaggaaggaggattacctgagcttgggaagaggacgttgcagtgagccaagatcacgccactgcactccagcctggtcaatggagcaagaccctgtttgggtggggaggggaggggagtggaggggagaggagaaaggaaagaaaggaaaggaaagaaaatagaaagaaggaagggggagggaaggaaggaaggaaaaagagagagaaaaagaatgaagaacaaaaatgaaaattttttaaaaacctaaggttaaaataaaccctttttcttcatacagattaaacacgagttcaaattacagctttgctgcttaatagcttggtgacctaggacaagttatctaacctctctgtgcctcagtttcctcatttaaaaatagggcaataataatatctaccacataaggtatttgctgatcacaaatacctggcaacccagtagatactcagtgtaataattattatttttataatttctgcctaagtacaaagataattcttgggttaacctaaaggtagattttcttttatttcttcctgtttcttttatttttcttgttcaccttaaagaattaaaaagaaaatcgattccagcattttggaataaaaatttgcatcaaaatcaatttattcattttattgacatatgaacaaaatgtcatttgtttattcaataaacatttgttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaaaaaaaaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggtagatcacctgaggtcaagagttcaaaaccagcctgaccaacatggtaaaaccccgactctactaaaaatacaaaaattagctgggcgtggtggtgggtgcctgtaatcccagctactcggaaggctgaggcagaacaggagaatcacttgaacctgggaggcggaggttgcagtgagccaagatcgagccattgcactccagcctgggcaacaagagcgagactccatctcaaaaaaaaaaaaaaaaaaaaaatagatgaacaagttgaattatgatgagcaacttgaattatggaggatgctagaaatactgtttcctccacagtcagggcttcctaccaacatagtcacttttagggtttttgacctgaaaagttctgtggcatattttttctttgctatccactttttttttccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattctattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaattaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaggtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaattttttttttgtttttgaaatggaatctcactctgtcgcccaggctgcagtgcagcggcatgacctaggctcactgcaacctccacctcccaggttcaagtggttctcctgcctcagccttccgagtagctgggattacaggcgcatgccaccacacctggctaatttttgtatttttagtagagacaaggtttcgccatgttggccagggtggtttcgaactcctgacctcaagtgatccgcctgcctcagcctcccaaagtgctaggattacagataagatccaccttgcctggcctcactcagtagaattttttttgagattatgctaccatccatgttgttgcacctatcactacagctggccctccatatctgcaggttcctcatccatagattcaacgaaccatggatggagaatatttggaaaaaataaaatatataaaacaacaatacaacaataaaaacagtagaaaatttaaaatacagtataattatgtacataccatttacactgtattaggtacttagagtatacctgaggctgtatacaaacattatgtcatttcataaaaaagacctcagcatctgtggactttggtaactgcagggggtcctggagccaatcccctgcagacaccgagggacaactgttcactcctttttattgctgagtagtattccggttgtgtggaaatgccatctctactaaaaatgcacaaattaggcaggtgtggtggcacatgcctgtaatcccagctactcaggaggctgaggcacgagaagtgcttgaacttgagaggtggaggttgcaatgagccgagattgcaccactgcactctaacctgggcgacagagtgggactctgtctaaaaaaaaaagtaagaaataaaaatgttttctgaagagcagaagtttttaattttgaccagctttaagttagcatttttttcttaaatggcttgtgattttttgtttcttacctaagaaatctttaagaacctgttgtctaatccagcgtctaaaagattttctcctatgtcttctcccagaaatgatacacatttaggtctatgatccattttgagtcaatttgcatatgtgatgtatcttttttattttttatttttttgtagaaatgaggtctcagtatgttccccaggctggtctcggactcctggtctcaagtgatcctcctgcctcacctcccagagtgctgagattacaggcatgagacaccgtgcctggccttctttgcaggatatatatatagatatatatatatataaatcagccaggtgtggtggcacacgcctgtagtcccagctactagggaacctgagtcaggaggatcacttgaacccaggaagtggaggttgcagtgagccaagatggcaccactgcactccagcttgggtgacagagcaagaccctgtctaaaatatatatatatttatatatatgtacgtgtatatatgtatatgtatgcctgcagggccctattgtgagtttgttacacaatttactgcaacttcaattgtgccaccagcccccacaatatggcaagctaaatagagactcagttatgctagggctggttgagggaattttgcaagattagcatggaaagggcccttcatttagcactctgctccgttcatttttgtcaggtcactttcttatcttcaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaactgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagacttgtcagtatactttaaaacaatcctgggaacagttctagattgaaggagactaaagaatcatgtactaagtgtaatgtctgatgtttgattggattctgaattttttaagccatgttatgattaggacaattgtgaaaatgtgtatacggaccgcatagtagacaatgataatatgaagttccattgagtgatgatagtcctctggttatgtcggagaatgccttggttcttaggggctgcacactgaagtcttcaatggtgaagggtcattatgtctgcaactgactctcaaatggttttgtccagaaaatgtatagacatacacacacggaaagcaaatgtggcaaagtattagcaactactgattccagatgaaagttatacaggtgttcattataccatttgaaaatgtttcccagccattctaaggcttaaaggaaaaaaagaaaatgtttaaaataaaaagttgggggcagaaaaagaataccaaaaattttgggctcatgcctgtaatcccagcactttgggaggccaaagagagagggttgcttgtgcccaggagttcgagaccagcctggacaacatggtgaaaccccatttctacaaaatatacaaaaattagccaggtgtggtggcacacacctgtagttctaggtactcaggaggctgaggtgggaggatcacttgagcacaggagacagaggctgcagtgagccaagattgcaccactgcactcagcctgtgtaacagagcgagacccggcctcaaaataaacaaaagaaacacctttgtggcagaggtaaggttgctatacaacaaaatgctgggttacggttccgggtccattccatatgaagatcagaggcttccactggaccccaaggaatactactagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactcactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatcttccatgacattggcattttttaagagtcaaagatagctgtcttgtaaattgtcccacaatccggatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaaaaaaaaaaaaattagctgggcatggtggtgcaagcctatactcccagctactcaggaggctgaatttggaggatcccttgagcccaggggggttgaggctgcattgaggtataattttgccactgtatttcagcctgggtgacaaaataaaaataaaaataaaaaataataattttccccttggtaattaataaataatctgtgggttgttactttgagttcagtgaagatcctgttctcaaatgttttttcacccaaatgtgcatcaatgataatccttgtctgaatgaatttgtattacactgacggttgcaaagtgacacttttaaaaattctgtcattccttctacatttactagctggcattatttcattgaagaagaactcctcctctttctttttcaatatcactcttcgtggattcttctttatattaaatatgtggtaacttattgttgttattcttttgaatgctcaaattgtccagatttgaccaatgcagtctttgttattttttaactccgcaatccaggttaaactatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattccagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcacgagtccagccccaagggaggtggaacagccccacacacagcaggggcctgagaagttagcgggaaacgccgtctacaccaagccttcgttcacccaagagcataaggcagcagtctctgtgctgaaacccttctccaagggcgcgccttctacctccagccctgcaaaagccctaccacaggtgagagacagatcgaaagacttaacccacgctatttccattttagaaagtgcaaaggctagagttacaaatacgaagacgtctaaaccaatcgtacatgccagaaaaaaataccgctttcacaaaactcgctcccacgtgacccacagaacaaccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctctttcagaacattttatagagaagaataatacaaaacacacaactgcaagaaatgcctttgaagaaaatgattttatggaaaacactaacatgccagaaggaaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccagctacttggaaggctgaggtgggaggatcacctgagcccagggaggtcgagtctagtgaacggtgattgcaccacggtacccaagcctgggtgacagagtgagaccctctttcaaaaaaataaaaaagaacctgtcagctactcacctggaatactggggttttgaatagttagctctcattctggttttttttttgtgtgtttttttttttagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttattgcagtgtatatttcaggatttttaaaggatcctcgctttcagatctctgtgaattgaaaccaagtgaatcccactagactattttaagaagtcgatataatagcaaaatttctcccacccaaaactatgtcaacaattggatgtactcatcaagtcacccttactctgccactaatttatttccttgttgctgaaatgatgagagaggtataatctccaccctcacggagttgtcatcaccctggagaggaaggagagagccaaaagacatacgtattgtcttgtagacttattagatttacacagtatcatcctccagtgtgtaaggcattgtctaaataggtccagttaaagcactacagagtagccatcttttacaaaaatttttggccacatttttaagttcactggtgaggaggaacgtctcatactctagccctcctgagcctataccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgctaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctggtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggcttaagggatcctcctgcctcagcttcctgagtggctgggactacaggcaggcagctaatttaaaaaatgtgttcgtagagacaaggtcttgctatgttgcccaggctggttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaaaaaaaaaccaataaaaatacaaacagaaagtacaatataacaactgtcaacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtacatgagacttataatgaataaaaggaatcaatacagatttggagatggtggttgttgtcatagataatcttaattgcgttttcttctaaaacagatatgttgtcaccgaaggtcattacaagaagatgaagaaggattctcaaggtaaatattagtctggtgattttttttttcttctcttttgagatggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagggcacttgtctccttcaaggctgatggaaggtaggatatgtgagtccttcctcttaagtggcaggaaacagtattttctcttttatttctttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaagaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtcagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatctgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatgaatgaaaattgtgattccgatgaagcctgccagagaaacaaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacattaaaaaggcaagagaagccctaagcagagtgagcaccagactccacaggttaagggctcagtcacacagaaccatccgcatgtcagaccccaggtgcaaggccaagcatcacctatgcatctgaccaactggctgtaaattggaggtccccacaactccctcctcaggtttgaacatttgctagaacagctcatggaacccaggaaaacagttttcttactagtgctgatttattacaaaggatattttaaaggacacaaatgatgaagccagttgaagagatacacagggtgaggtttggaagggtccttgtggagttggggtgcaccactctcctggaacatggatgtgttcgccaacccggaagctctccaagtcctgtcttttaaggagttttctggaggctttatcacgtaggcatgattgagctccagctctactccccacgccagaggatggggaatggggctgacagcacaacgcttccaaccataggtctttttggtgaccagtccccaaataaggagcccaccaagagtcacctcatgagaacaaaggacgcttctatcacccagaaaattccaagggatttaggagctctgtgtcaggaaccaggtttaaggaccaaatgttagaacaaaagatgtgcaaccataaaaaacagcgagatcatgtcttttgcaggaacacagatggagctagaggccattatcctcagcaaactaagacaggaacagaaaaccaaatactgtatgttcttttaagtgggagcaaaatgatgagaactcataaacaacagacactgggccctacctgagggtggagggtgggaggagggagaggagcagaaaaaactattgggtactaggcttggtacctgggtgatgaaataatctgtacaacaaacccccatgacacaagtttagctatataacgaacgtgcatatgtaccccctaacctaaaaggaaagtttaaaaaggaaaaaacacctaggagaaaagaaaaatgataaattaacaaaggacaatgctcttagcaccgccatcattcaggaatttccaagggttttaggagctttgtgttaggaactggggtcagagaccaaatatatatttcttcttatgttacactaccccagataggaaaacagaaattactctagatatttcaaacaaaaaagggttgtatataggcaattagtgcttatcactggaggtgctagaggtggtgaaggttgtggggatggggttgcaccactggctttcaggctactttaccacagctgatttccagaggatggaagaagtcaggaaacttgggaaaccgctgctgaggtccttgcagccccacggtccccaggctggtgactggtgggggagtatggagtccagctgaccaccagagcctgcacacctgctgctatgggggaggaaaggatgacttctacctcctttccacattccaaattccacgtgactacattttattggcagcaccccgctggcaagtgagccttgatgtgtgcttcctgggcttctggcacctgcacagaaaggggtgaaatgagtgtcacgagcagccaccactctgcatcacacctccacatccaggtgtgctggagagccccacttacacttggagtgtcctggtgccctacccacttttggtaggtgtttgggtgtctgaggctttgcaaaagaagaaggtggggagtctatggtggagtcacatggtggagacctagctaagtcagaggcctggagaggtgtcactggctgggcagcaggtaacacacaatcatcctgagctgattggagaaacacctgggattgattcagagttttttctggaatgttttcactggaatgaaagctgagcggtctgcaggccatatagtattggagaaaacttagccctcattgaaaaaggctgccagagaaaaggtatccacagggaaattcaggagttttgtttgtttttttttctttttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattacaggcacccaccaccatgcccggccaatttttttttttttttctaaaaacagtttcaccatgttggccaggctagtcttgaactcctgacctcaagtgatccgctcaccttggcctcccaaagtgctgggattacaggcatgagtcactgtgccccgccaggaaattcagtttctgaaaatacacctgtggatctctagcctagaaaaagggacctcttttattctttttttttttttttccagagacgggcctcactttgttgcccaggctggttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggccccgcgcctggggatgggaggcaggactgcaccttcacagggacgcttccaccctaccccggaggtcagggcctctcgcccagctctggctctgaggtcctggagggagggagatgctgttgcgactcagaagattgggggagggccacccccattcgagaagagtgaaaatcctgagcctgaagaagtggaaccggttggagccgaggctttagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactggcttacgacatgagagctcaatatgctccttatttaacgcactgttgtatcaggtccctgtgggagccactggctctatagcctaataaaggagcgggtgcacgcactggattggtgagctaccgccactgcaacgcgtcctaatcaaccatcctaaacggcggctggaacaaggttctcgcaggcctgtgcttgggcttgaacgctggtccagccgctgcgctctgtggctccctgtaggcctgcggatcggccagggggctccgttccttttgggcggaggctgaagaagcagcggctgcaccagagaaggccctctgggtgaaggtgggagcgcacggggcccgcggaaccacctaaggcgacttcagacgtgggctcggaactggcagcctttcgtttctgcttcattccaaggccagagcaagccacgtgggcaaacccaaagccaggggacaggaaagtatcctccacccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagcacatagtgctaagtatttggcttgtaatctgtagagactctgccatttggagctgggatctgtccccagagctgtcagacaccaaatcccgtatctactgccacccaaagggacctccagaagaaaggggttatacagggtcaaacaccaaggcaggttagtgaaatttctctagaggccatttaaagctggagtctcaccacctgaactgccctcagaggaaggctgtctagggcacaaacctagtcaggggtccacatggacttaaggacaatttttttttttttttttttttgagacagtctcattctgtcatcaaggctcgagtgcagtggtgtgaactcagctcactgcaagtctcaacctcctgggctcaggtgatcctcccacctcagcctcccgagtagcgggaaccacaggctcgtgccatgatgcccaattaattttcttttaaattttttgtagagatgaggtctccccgtgttgctcagtctaatcttgaactcctggactcaaatgatcctcctgcctctgctcctcaaagtcctgggactacaggtgtgagccaatgcacctggcctcttatgaataattttaaaaacaatgaggttcaccgtcagagcccctgctgctctaccaagtcccttggcccctctcaacagggcaaaagcaagatgagccccagatgttctgcttaatgaccacctttcccaggagactttgctctttaaaggagaaccacttagagatatgagcaaccttaaagaatgccaccagcactagtgaatgccaggcacgggccacgtgggtggagagtatactttagggcagtcactcatggtaaattatttccaccagcccccagaagtgactattcaatgtccaactatgtcaggcccaggctaataaaagtagaggcatgaggaacctagggttgttctgaagtgccttgattatggtacatgtggaagattttagagcttgttgtaaaaagtgatgacccatggccccccaggctgggtctgggattccctttgtggattacaagaggatattatgcagcagtttttaaaaatgaggcagactgggacaatctatctccaagatgcataggtgctgttaagggaacaaagcaagatttagtagggcgtgtatagtatgctactgtgcgctgtgcgttatctgtacagaactgtgaggtctgatacagtagccactagccacatatggctatttacatataaatttaggttggccacagtggctcatgcctgtaatcctagcactttgggaggccaagtgggaggatagcttgaggccaatagttcaagaacaccctgggcaacatagtgaagccccttttctacaaaaaatttatttatttatttatttttattttttttgagacgggtctcactctgtcacccaggctggagtgcagtggcgcagtctcagcttattacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttaggaggctgaggtgggaggatttcttgagcccaggaggtcaaggttgcagtgacctatgactgcaccactgcactccagcctggacaacagagtgaggccctgtctcaaaaaataaataaataggagtttgaggccatgttcacacatcactgcagtccagtctggtaaacagagcaagacgctgagtctttaacaaaaaaaaaaaaatttttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaactggtaatggcggttgccttccgggagggaaactgggagagtgcagggctgtatgcccttttgtacctcttgaatttcatatcatgcgtttgtactaggtgtttacaaattattttaaaaacatactgggaattaggaatccccatatggaatcactgcagtgggacactgattcccaaaaaattactttgcaatttgcctaaaacaaattaagctaatagctatcatgatttcatatttaatattttttcacagcttagagtttttttagctcctgttgctatctctctgctcttatgagctcacagggtgacaaagtgaattagtaagtagcaggagaacattaaaggaaaaactcctgggcaacagggcaaaacgccggctctacagaaaatacaaaacattagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagatatgagccactgcatccaactttggttcttgtttgtctgttttgttttgttttggtttgtttttttgacagagttttgctgtgccacccaggcagtgactcagcctcggctcactgcagccttgaccttctggcctcgagtgatcctcccacctcagcgccaccccccactgccctccaatatctgggactacaggtgcgcgtgaccgcacacagctaatttttaaattttttgtagagatagggtttcactatgtggctcaggctggtctccaactcctggactaagcgatctgcctgccttggccacctcccaaagtgtgagccaccatgcccacccattgaacattgaagctagactgggcaaacccttaagcctaaaccagtaacagtttttcacaagttcatagatgttactgtggttaataacacacaaattcatttaaaagcatgtgtgtccacatagtaatttttggtccttatttttatttttatttttcagttaatggatattaaagatacaactttattttgttttttttgagacagggtctcactctgtcacccaggctggagtgcagtggcatgatcagagctcattgcaacctccacctcctgggttcaagagattctcctccctcagcttcctgagtagctgggattgcaggtacatgcaaccacacctggctaatttttgtactttttgtagagatagggttttaccatgttgctcaggctggttttgaactcctgagctcaagtgatccacctgcctcggcctcccaaactgctgggattacacaagtgagccaccacacccggcctaaagatataatttctatcatgaggaggtccaagaactattctctttttctttttttaatgttagaaagggattaactgggtatgtgctgcagcaaagggaggggaaattaagcaagaagagaagggagccaggaaataaaggccccaacccaggaagcagttaagcaaagttccaggatgacccatgtgacaagtttaggggataacttgagcacatggaggacagaacttggagagggcactgtgggcctgggcgccacctgctccgccagagcactggaagagaacgagggcacgataatggcagatggcactgaaagaaaaggagagagcttgaggcacccttgggggaagcagccatcatcagagtgtattttatttttattttattatattttgagatagagtctcactctgttgcccaggctggagtgcagtggcatgatctcggctcactgcaacctccacctcccaggttcaagtgattctctgcctcagcctcccaagtagctgagactacaggggggcaccaccacacccggctaatttttgtatttttagtagagatggggtttctccatgttggccaggttggtcttgaactcccgacctcaggtgatccgcccaccttggcctcccgaagtgctgggattacaggcgtgagccaccatgcctgacctcacagcacattattaagctctgtggtgaataatatttatatagtcacaattctgtaaacactgttcattttctacaaattgtggcaaacccaaacctcaagaatggacagggctagggtgtaaaagagctaagtccttgccaggtttaccaggaaggcaacagacagtgtctaaaactatgagacagctgggcgcggtggctcacgcctgtaatcccagcactttgggaggccgaggcgggtggatcacgtgaggtcaggagtttgagatcagccttgacaacatggtgaaaccccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaaggagaaaaatatttatccctaataactaatggaccatcttacgccgtctataaaaatatcaattaagaaatcacggccgggcacagtggctcacgtctgtaatcccagcactttgggaggccgaggcgggcaaatcacttgaggtcaggagtttaagactagcctggcaaacgtggtgaaaccccatctctactgaaaatataaacaaattagccaggcatggtgacgggcacctgtaatcccagctactcgggaggctgaggcaggagaattgcttgacccaggaggtggaggttgcagtgagccgagatcacaccacttcactccagcctgggtgacagcaagactccgcctcaaaaaacaacaacaacaacaaaaaacgcggtgatacacgcctataatcccagcactttgggaggccaaggcgggcggatcacaaggtcaagagatccaagaccatcctggccaacatggtaaaaccccatctctactaaaaatacaaaaattagctgggcatggcgcgcacctgtagtcccagctacttgggcggctgaagcaggagaatcgcttgaacctgggaggtggaggttgcagcgagccgagattgtgccactgcactccagcctggcgacaaagcgagactccgtctcaaaaaaataaaaaagaaatcagaaactgttcaaattccaatctatacaagtgaaacctacacagttaaatgtcttaatagagagctaaaagcattaagttctgtcatactcaacatactgatgaaaaaaatttgaactaaaagacagcctgatctttagaaactggcagaaaaaataggggctgcatccaagaccactcacggcacgtccattcttccagcagctcccaactgctattttatgaaaagtccaaatttcccaccccaaggtcctagagtacagccagctccctaccatcaaaaacaatagctaccaaaactcagtaaaattaggcttgttatgaagagaagattgaagaaataaaggtatttatttcatcttggtatttgaatgtggaaactcccagtagggtaagaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaattctctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctttcttctacaaactatatttcagggaaaccaaatatttgatgagggaattctttgtttagaaggattttagctaataaatgcagaggaataacaagatttaggaggggggagaaatcaccattttgtgacttctaataaaataatgggtctaggcaacagttttcaatggatgctaaaacgattaggtgaaaagttgatggagaattttaattcaggggaattaggctgataccatctgaaaccatttggcatcattaaaaatgtgacaacctggtggctgccagggaggaaggggagagggtgggggaagaacagaagttatagtttatgggcacaaagttttggttttacaagatgaaaatagttacagaaatgaatggtggtgatggttgcagaatattatgactgactatacacttaaaaatgtttaagatagagctgggtgcagtgttgcacacctgtagtcccagttatgcaggaggctgaggtaggagaaccacttgagcccatgagttcgagaccagtctgagtaacatatagagacctcatctcacaaaaacatcactaccacaaaacaaaacaaaacaaattgttaagatgctaaattttaacttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaaaactagccggacgtggtggctcacgcctatagtcccagctactcgggaggctaaggcaggagaatcacttgaacccaggaggctggggttgcagtgagccgagactgcaccactgcactccagcctggccaatagagggagactccgtctcaaaaaaaaaaaaaaaaagaaaagaaaacatagttacccagcaattccacttctaggcatatacccaaagaactcaaagcagggactcaaacagatacttggacatgaatcttcatagcaacactattcataatagacaaaaagcagaagcaactcaagagtccatcgatagatgaatggataaacaaaatgtggtatatccataaaatagaatatcattcagccataaaaggaattaagttctgatacatactacagcatagatgaaccttgaaaacattgtactaagtgaaagaggccaggcagctaaacttccaaagactaatatacaattccactgaataggcaaattcatagacagaggatagaataaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaaaaataaacttgtaaattttatattatatatactttgccacaataaaaatttttttaaaaatgtctaagtgtgacaaccgaacttctgtgttaggataggaagaatacttatgaagtattcttgcccctgaaatgaaccaaaatctaatcaagtctctagaataaacaaccagttcacaggaaatccacagatagccaagcaagttagatggcaccataataaagtaatcaaccaaatccagaatgtggaataagcagttaaaaaaaaaaaaaaagggggggggaggccaggcgaggtggctcacactatggtctcagcactttgggaggccaaggtgggcagatgcttgagcccaggagtttgagaccagattgggcaacatggtgaaaatccatctctataaaaagtacaaaaaaatttgctaggtgtgatggtatgcacctgtggtcccagctacctgggaggctgaagtcagacaatcgcttgactccaggaggcagaggttacagtgagccaagattgtgccactgcacgagaccctgtctccaaaaaaaaaaaggaaaaaaaaaggcatagagaaagaacaactgctgtagaataaaagactaaagaggcaaaacaacaaaatgcactgtgcgaactctgatccagatgcaaacaaagcagatgtagaaaagatgtagaaaggatactttttttttctcttttttttttttttttgagatggagtctcgccctgtcgcccaggctggggtgcaatggcgcaatctcggctcactgcaacctccgcctcctgggttcaagagaatctcctgtctcagcctcccgagtagctgggattacaggcatgcaccaccaagcctggctaattttttttgcatatttttagtagagacagggtttcaccatgttggccaggctggtctccaactcctgacctcaggtgatccaccagccttggcttcccaaagtgctgggattacaggtgtaagccaccacactcagccaggatacatttgatacaactggagaaattagaataaggactaggtgctagatattaaagaattattattaattttggagatgttataatagcatgaagattttatatatatatatatgccttatcagttggaaatgaacactaaaggacatatgaataaaaggcatcatgtctgggatgggcaaaatgcttataactgttgaggcttggtgatgggtacatgggggttcgttatgttatcctctctgtctttgtatttgttttagattttccactaaaaaagttaaaaaaataaatgcactactttgagaaaaaacattctaaaatctatagcctggaaaagataactgcaaatagagttaattgccaaaggtaacagctaaaacaatgatataaaatataaagggacagtcgacttgggtatttcatctggaaagactgacgaatatgtaagtctttactatcaagtacatgcaggagaatcttcaaaacaaacagactccaaataaattctaaaatgagaaatttgtagattccatatggttaatattttacatgaaaatcggggtgtaaaaactatagtcagccctctgtatccacagattcaacccaccttgaaccaaaaatattaaaaagtaataacgcaggccggacacggtggctcacgcctataatcccagaactttgggaggccgaggcgggtggatcacctgaggtcgggagttcgagaccagcctgaccaacatggagaaaccccgtctctactaaaaatacaaaattagccgggcgtggtggtgcatgcctgtaatcccagctactcaggaggctgaggcaggagaaccacttgaacccgggaggcggaggttgtggttagccgagatcgcgccattgcactccagcctaggcaacaagagtgaaactccgtctcaaaaaataaataaataagtaaataaataaaaataataacgcaacagtaaaaaaaaaaaatacaaataatacagtctaactatatagcatttacatgctagtagacataagaagtaatctagtagtgatttaaagtagacaggggggctgggcacagtggctcacgcctataagcccagcactttgggaggccaaggtgagcgaatcacctgagatcagaagttcgagaccagcctgaccaacatggtgaaaccccatctctactaaaaatacaaaaattggccaggcgtggtggtgcatgcctgtaaccccagctacttgggaggctgaggcagaagaaccacttgaacctgggaggcggaggttgcagggaggcaagatcacaccactgcactccagcctgggcaacagggcaagactctgtctcacaaaagaaacctccccagtaagtataaagagaccctaagagaggaaatggctgacagtgtaaatagagcagagcaccagaaggtatcacttcaagcatccgtctttagagacatttcacagaaacagtatcgaggctacaaaccgaataatctttaccttttgtgttctggaaaaaatgctgccacagaggtctgattttgaagtggctgccaacatcccagacagcgaaggtgttatttttatattctactgtctccacacagaaacctaaatgaaacatggggaaaacatttaattatgatttgtgctggttgaacaattcaaaataatttcaacatgcggacagtacttttaatttacaaagcagcctgctagtcaaagatctatagccttcaaagagaatgtgctggccccctcgcccattcatcaggacaggtgtctcaaaccttctctactctccaatctctagccacgcacctgccctttctctcagcaggagactatcacagtgtacttcagagcagagaagccgccgatgggaatgacttccacttccaccatacagtgtaaaagccagtctacatctttacccatgcttttcttcctccctcttggaacaacagaagaaggtaactctcttccaccaactccctccctctatgagccagatccaccctacccagactgtctggaactttttactattcctattctctcccatatctgaatatctccaatctgttcaccttggcatgcttaagccttttacatctttaaaaacaacaaaacaaacctttccttgatccccacatcttcatcgcactctcttccttcacatcttcaccctctatttgctttttttttttttaagagacagggccttgctgtgttggccaggctggagcacagaggtacaatcatagctcactgcagcctcaaactcctgtgctcaagggatcctcctgcttcagcctcccaagcagctagaactataagcatgagccaccatacctagctaaatttaaaaaattttttgtagacacagggtctcactatgttgctcagattggtctaaaactcctgaggtcaagcaacctgtccactaagctttcttcggtcctctcacgcaacagcaccttagctctgctccaccattgggtagctggttttcagtaaggtcagcagtgatcaccaggtcaataaatctaacacaggccttctcagttcttccataatttgatcttctatctgacgctactgctcactccctccttgacacccttccccagcttcccttttccttctatctctatggctgtactgtctcagtctccttagtgaactcagccacgtttaactgatcctgcaatgatgggagtcgccctggctctcactggccccatccactctcctctttctgcacccctccctaggcaatctcactcactcccacgacttcattcctatctctgtactaactctgagatttatatcccccaacctagccctctctcctgagcttcaggctcataatctaacagctttggcaaatgtcttcaaggccccaaaacaaggtgatcagtcaaaaatggaatttaaggtccctacccccaacctcctcctctgctagttatcccatcattgacttcgttccacaagctgatagcctgagaggtgccctggaaacatccgatgctcgcacccctagaaccctactaccacaccttatcaattcaaccccttcaacaactaatagtcaccctaacccaacagaccatcatttctagcctcaattcctgaaaccatataactaatttcacctcagccactctccctctctccatccggtcaccatcttctaaacaaagcaatagcttaaaaacacatagtgtggtcacgtcatttctctacacatttatgtttgattggaatattttcaaacttaaaaaagaaagaataatcgccccaaaaaataaaattaaaaattaaaaaaaaaagaaagaataagccgagcacagtagctcacacctgtaaccccagcactttgggaggctgaggtgggcagattgctttgagctcaggagtttgagaccagcctgggcaacatggtgaaaccctgtctctacaaaaaaacacaaagattagccaggcattggtgccgtgtgcctatagtcccagctacttgggaggctgagacaggagaactgcttgaagcaaacattgcagtgagctgagatcacaccaccgcaccccagcctggatgacagaataacatccaagaaagaaaagaaagaaaagaggaagagagagacagagagagagagacagagatgggaggggaggggaggggaggaaggaaaggacagaaaagggagggagggagggagggagggaggaagggaggaagggaggaagggaggaaaggaaaagaaggaaagatgtccccttagcggcttcccacacccaaatcccaaacatgactgtcaagacccaagcaagctgggtctgctcaccttccaaacctcaattctagtcatgccttattttagtgagagacactcgttacattgcaacaatctaaattcttgctaaataaataaatacaatgccattccaatcctataatgatggtaggggcaggggcaggaaacttagcaaaattatctaaaatttaacctggagaaataaacaagtaagcataaccaggaaatctctgaaaatgagtaatgaattatttttaaggatatgccaagccctagtaacacttgaatagagttcaaatataaatgcaacaggtacttgcccaaaaaaagacacacataccagtgagaatttagtatgtaacaaagaaggcatttcaaatcagcatggaaaaattattcaataaatgacattgaacaactgtctaccccagcaccgtccaatacatagtcactagccatttgtgactatttgtttatgtttttgttttattttgttttgtttttgagacagagtctcgctcttgtcacccaggctggagtgtatggtgcgatctcggctcactgaaacctccgcctcccggattcaagtgattctgctgcctcagcctcccaagtagctgggattacaggcgcctgccaccacgcccattttgcaattttagtagagacggggtttcaccatgttggccaggctggtctcgaactcctgacctcaggtaacccgcctgcctcagcctcccaaagtgctgagattacaggcgtgagccaccatgcccggcctatttatttattttttgagacacagtcttgctctgtaacctaggttgaagtgcaatggtgcaatatcagctcactgcaacctgtgcctcccgggctgaagtgattctcctgccttaacctcccgagtagctgggattacaggtgcatgccactactaatttttgtatttttagtagatatggggtttcaccacgttggccacgctgatctcgaactcctggtctcaagtgatcttcccacctcaacctcccaaagtgctgggattataggcataagccactgcgcctggcaacgtggctatttaaacttaaagttaaaatcaaaaatcaatcaataaataaaaataaataaaaaataaacttaaagttaaatacaattaaaagttcagttcccggctggacacagtggctcatgcctgtaatcccaacactctggggggccaaggtggacggatcacccgaggtcaggagttcgagaccagcctggccaacagggtaaaactccgtctccactaataatacaaaaattagccgggtgtggtggcgtgcacctctaatcccagcttctcaggatgctgaggcagaagaatgacttgaacccagggggcggatgttgcagtgatctgagatcgcgccactgcactccagcctgggtgacagagcaagattccatctcaaaaaacaaaaaagttcagttcctcagttgcattagccacatttcaagcacatgaacagtcacatggctattggctacgacactaaacagcacagacacagaacattttaatcactgcagaaagtgcctcctgggcagcactggcttatccatttgaaaaatttaaccaaattactaccttacacacaaccatctcataactcgaacattctcctcggtttcccactcctcaatcgatgcaatctctgcagctactgcccaagttgaaagttgatcatttggagaccaggtgcggtggctcacgcctgtaatcccagcacttagccgggcagatcatttgaggtcaggagttccagaccagcctgcccaacatggtgaaaccctgtctctaccacaaatacaaaaattagccttgcatggtggtgaacgtctgtaattccacctactcaggaggctgaggcatgagaatcgcctgaacccaggaggcggaggttgtagtgagccgagatcgcgccactgtacttcagcctggggtgacagagcgagactctatctcaaaaaaaaaaaaaaagaaagttgatcatttgagtcctgtgcctaattcaatattcagaacagaacagtagtaatgttcacatgccacctgtggggtgtatcctcagtcagaagtttggatctagaggcagttcacaaggcaaagattcagttctgtcaaaactcgctttgtaaatctcttaacaagccggtaaaacacagtgctggttcacagtaagagcagtgcagccagcttgtctatttctctagttggacatcatctcaagcagttggtttgagccagagtgaagaaaagaaatcacactccatctctaagcactgggagcgtacttggtgtagagatgagatgctgccactaaggaaggccagctggaacagaggctgactgaggaggcaccagcagattcccagctcccacctcagccttctgctgggacactagctgcgaggaatgaggggcagaactaccctccctgttttgcccattatctttttcttttttgccaagcaaatggggttaaatttgcttagcctccatgtgttcacatgtctcccttgtgaacctaagaatgtgcaagccactagaaaaggatacataacctggccaggcgcggaggctcatgcctgtaatcccagcactttgggaaaccatggcgggaggatcgcttgagcccaggagttcaagaccagcctaggcaacatggcaaaaccccgtctctactaaaaatacaaaaattagctgggcatgctggtgcacgcctgtagttccagctactcaggagggagatggaaggatcacttgagcccaggaagttgagactgcagtgagcagagatgtaccactgcactccagcctgggtgacagagtcaaaaaaaaaagaaaaggatatatataacctggtttttggcctctaaaaatgtatgctcatggagtagacaagatttttaaaaagaattattcaataacataagaagcatgtaaaaataaaacatatttctctggtgaaacagaacctaaaaaatatatataacatactaaattgtaaactggaattgccacaggtctttcattaacttacctactgtagggacggcaggcacagtctcccccagcttcaatttatacaagatggtggtttttccagctgtatccaaactcaatataagaatccgcatcttttttttcccaagtagacttttaaagagcttttcaaaaatgtttcccattgtaatttaatcgaattctgtaacatgacaagaaaagcaagccaaataattgttctctgcagagatatagaagcaacacgcagaaaatacaagtgtcaattagaaatggctcccaggaaaaattcaacaattttaggtacactttggccaatgagtagtgagtcttgtcttcaaagggaaactcaactaaacctttccatgccttaccagaaaattctattttccactgcagcatccaagagggatatgcaacatagcctcagcactgctatgacagtggcagcctttagtcatttagtacagaagtacaaggccaggtgcggtagctcacgcctgtaatcccagcactttgggaggccaaggtgggtggatcacctgaggtcatgggttcaagaccagcctggccaacatggtgaaaccccgtctctactaaaaacacaaaaattagctgggcacggtggtgcacgcctgtagtaccagctactcaggatgctaaggcataggaatcacttgaacctggggaggcagaggttgcagtaagccaggaccacgccactgcactctagtctgggcaacagagcaagactgtctcaaaaaattaattaattaattaattttttttaaaaaacaagtacagaagcaatgatacaacaaatacaactatacctcattctaaactctactgaaatgagaatttatgaaacagagaagctttttattttatgcaatataaaacaaagtctttaagacaggttaaacaacaatatcccttggaaacgtagtagttccttatggctagcagacaccttggaaataacctaagaaatttcagaggcaaagaaattcagcgttgggaagcttcactgccaagagagataacttggcagagttgaggaggcaccacagcatccagttttcgtttgagttttttgttttgttttgagacagggtctcgctctgtcacccaggctggagtgcagtggcacaatcacggctcactgcaacctcaacctccccatctcaaacaatcctcccacctcagcctctggagcagctgcgaccacaggcatacgccacctcgctcagctaatttttgtattttttgtggaaatgaggtctcactatatttcccaggctaatctcgaacccctgggctcaagtgatcttcccacctcagcctcccaaagtgctgggattacaggcgtgagctaccaggcccagccagtatccagtgttctattgctgtaactatcaccttactctcaaccagttcttagaactttttatttaagtataatttacatacagatataaacatacatgataactgtaaagttcaatacattttcatgaaccaaacacacctatgtaaccaaatcaagaaaagatgatttatcaggctgggcacagtggctcatgcctgtaatcccaacactttgggagaccaaggtgggtggatcacctgaggtcaagagttcgagaccagcctggccaaaatggtgaaaccccgtctctactaaaaatacaaaaattagctaggtgtagtggcacacacatgcagtcccagctactcagaaggctaaggcacaagaatcacttgaacctgggaggtggaggttgaagtgagccaagattgggccactgaactccagcccagggcaacagagtgagactccatctcaaaaaaaaaaaaaaaaaaaaatgattatcagaccaattctccttgtgcctcctcccagtcattactccataaaaggtaatcactatattgacttctaacagcataaatgttcaatattttatttttcagtagaaatcatggtaggttatataaagtaagtcaatagtaaagtcagactaacttacagaaatttacagtctctttgagatcagcctacttgaaatgtgagcttgacattctaagtaaagacttacaagcagtgctgggtctacacctctaactaagctcttggaagtctgtaaagatcttcagaccaggcagggtggcttacccctgtaattccagcactttgggaggctgaggcaagagggtcactttagtttttgcttactgagataacagaagacaagggaggattgctttaggccaggagtacaagaccagcctgggcaacatagcgagaccctgcctctatttttaaaaataataaaacaaaaaaaaattcaaaaagaaaaagacatacatccttgttccagagactgtgatttattttctttttaaattgctaaccaaagaaagctttactcctgggcaggggaggaggaagacacaaggaggatagccaatctcccattcattcggactctggtaaccacagagcggaggtaaccaaattccacaggcctcaccgctgaaattcaacagtggccagcagtagcttaatatcatggattacgcccaagtacacaacattcctttctaggatgagagaaagcgagcacagaatttatcctgttcacaaatgtggcgtaagtgaccaaagaatgataaatgttttaatcattcaaagaaagtccattataggtctataaaagtccagtgcattgcagcactcaaaatcttgccgggcgacaaaactagagattccttttctttgtttcgaaaaacaaatctcacagatgaggagacttttcaggaacatgctgggggagggaaggtacttcccgctcagatgccccttgaggcagctagtcccaattccccctgccaaccgcacagacacaccaccttgacctccctctcccttctctttcctcttattgctactcatgtgccccaggcgcccgtggtcctgacacccctgcgccgctggagacccctctaaggtaagatggctccgactacagggcctttttggcacgctcagtctcccagccccaagcgccaaaagtgcattagggagaaacgtcggcacgacgtcaagggcgcgaacaagcgtggtggcccaggtgagcgtgcgcggcagccaggcacgcccggctcccggggaaagacgccccttttttgccccggctgccaggccgctccttctcaacttgtgcgcccctggaagagcaaagagagggccctgcgtggaacctatgaagcctccttcggttcctcgctgctccggccctagagagggcgaagaaggaacagcggagcccaatccctttccgaaagccaccgccgccctccagtttctggcccgcagacgaagtggagatccagccaggtcttgagtgctgccgccccatccctgcagccggagactcacctgttgccactcaaggtaccgctacctacaacaccgccgactccgcggcctttaggatttcagctcagttcagctaaaccacgacaggcgtgggggcaggaacagcaaccaaccaatcacccaccgcctcctggagcttttgcaccaatgagctcgaagttttgtgagtgacgacatatctggccaatgcaaagaagagtaagggcctgggagggagggagcgccgtaggcgacgccatgaagctctggcaataccatgttcatcttcaaatcacagttaaacgaattctggcgagacacgcccacgtcccccacccccgatgccatgtgcgaccaatcagaaaagcaaaaggattgtctatttgcacggccaatcagctgggaaaatcgccgaggtttgagctaacctcggagcgtccacaccaaccgggaggggacatgtgggccgggccaagttaatagtgccatggaaggaaatttaccgcggttgagttaaacgtagacattagtttggggcggtgttccgcgtaggaaataccacacactgacactgaaattaggcataaggaagttttcctattccgcctgaggctagactgccctcccacctctacacagattttcaagttggggaaaatactggccacccgcacctcgttaagacgtcgcagaaccagtcctcgtttccgagaaatgctttctatagtcagttccctaaatgcccaacttgttagctaaaaaggttacaaacgcctgtaaatggtacataactgaaatcatcagaacaacaaacatctattaaacatatactatgtgccagaaactatatcaagaacttcagcaggcccggcgcggtagctcacgcctggaaggccaaggctttgagctaggagttcgagaccagcctgagcaacatggcaaaaccccatctctgcaaaaaaaaacaaatttaaaattagccgggcatggtagcggctgtagtcccagctactcgggaggctgaggcaggaggatcacttgagcccaggaggtagaggctgcagagagccgtgatcacgccactgcactccagcctgggtgacaaagcgagaccctgtctcaaaaaacacgaacaaaaaaagttagaagatactgctagaattgactaaataaataaataaataaataagaaaaacaatgttacctgcaggaccgtaacgcccagtgaattacaaactattatccctggccagacgtggtggctcacacctgtaattccagcacactgggaggccgaggcgagcagatcacctgaggttgggagttcgagaccagcctgaccaacatggagaaaccccatctctactaaaaatataaaattagccgggcgtggtggcacacgcctgtaatcccagctacttgggaggctgagacaggagaattgcctgaacctgagaggcagaggttgcagtgagccaacatcgtgccactgcactccagcctagacgataaagcaagaccctgtctcaaaaaaaaagaaagaaaagaaactattatccctgctgttttacagaaaaatattaagtagcctgggtctgtcccactcccacaccttaatctttttctttctttttccttttttttttttttttgagacagggtctcactgtcgcccaggctggagtgcagtggtgcgatctcggctcgctgcaacctttgcttcccaggttcaagtgatcctcctgcctcagcctcacaagtagctggcattacaggcatgtgccactgcgcctgcctaatttttgtatttttagtagagacagggtttcaccatgttggccaggctggtcttgaactcctggcttcaagtgatccacccacctcagcctcgcaaagtgctgggattacaggcatgagccaccgcgcctggccaccttaatctttttaagcaaatacagaatggaaactgccctcacaggattaaggagagttacaagccaggctttaggcagcattatatatagttagctgttatccagggtgcacaagtgtactttgacccacttccctgcagctgctaactcactgaacatcactccacgtgctagaccacctcctacctgtttctccatggttcttaccatgagtaagaatttctgacgctagactcataagatcgttttgcccaagaacgggttgtttttcagatcctgaattctgacgtccccaaccaaggaacccactcagcacaagaatgaggtttcttggtctccctgtctcatgacttcgcccttcacttcttgaccaatcatcgatccccacactgcagcccctgtccagaggacttaaaaaccctgccccccaaacctctcagggaggtggatttgaggcttcttcccatctcctcattcagatgccctgtgattattaaactctttctttgctgcagccaggtgtctctgtatgctgactcactgtgcattgagcaaacaaaactattaaattacagtactacttactcttctaattacagtgcttatatgtatgagggttaatataaatacatatgactccttaaaaattaaagtatgttttttctgactataaaaattatacataaccgggtgcagtggctcacacctgtaatcccagcactttgggaggccgaggcgggcagatcatgaggttagatcaagaccatcatggccaacatgctgaaaccccgtctctactaaaaatacaaaaattagctgggcgtggtggtgcattcctgtaatcccagctacttgggaggctgaggcaggagaattgcttgaacccgggaggcggaggttgcagtgagccgagatagagccactgcactgggtgcagagcctgggtgacagagtgagactctgtctcaaacaacaacaacaacaacaaaaaactcatgctagtttaattttcatttatttgatgacttgctatttttccaaatgtttactagtatttttatttcatctattagaaatgatatattcatgtcctactgacttccaagggaaagatagaaagttgttttgccaggaactatgaaggttgtttgaatggagtcatcataacctaaaaaaaaggtgaaataacgaaggtgagatttttacttaccattgtttgttcctacagaaggaatgctggagctgataattatgagaatttatccttccatccctcatagcctaagaatattcattattttcccaatatctgcactgagcctgtaaaccaaaatgtatctgagacatgtctcaatcaatttacaagtttattttgccaaaattaaggatgcttacctgggagacaggcctgtgcctttttccaaaggtgattttgagggatttagtttggtttgtttgtttgtttttgagccagagtctcactctgttgcccagggtggagtgcagtggtacaatcttggctcgctgcaacctccacctcccaggttcaaatgattctcatgcctcagcctcccaagtagctgggattaacaggcgcgtgccaccacttctggctaatttttgtgtttttagtagagacggggtttcaccatgttagctaggttggtctccaactcctgacctcaggtgatccgcccacctcagcctcccaaagtgctgagattacaggtgtgagtcaccgcgcccggccagaaggatttaatattttatttatttatttatttatttatttatttatttttatttttgagacagagtcttgctctgtcacccaggctggagtgcggtggcacaatctcggctcactgcaacctccgcctcctgggttcaagccattctcctggctcagccgccccagtagctgggattacaggcgcacaccaccatgcccagctaatttttgttgtttttagtagagacggggtttcaccatgttggccaggctcgtctcgaactcctgaccttatgatccacctgcctcggcctcccaaagtgctgggattacaggcgtgagccacggtgcccagcaaggatttaatatttaaaatggaaaagcaggctggaagggaaagaaggagagtatggtcacattactgaattcacatgttgcaagagacaaggagcaagtaggggaatagtcaattatgtattactctcgtgcttaccataagataaggtggacatagagtagttagctgcagtcagtcctgcttaggaatgaaaggaaaggcaacttcttgcatgactcagctttcagcttaattttttttcttttggcagaatgaattgggttcccaagtttttattttcctttcacaagcctctgaataaacaaagttcctgcccacatggcattcaattgctaaacaattataatcacataaatacatacacatatacgtatatgttttatatatatatatatatatatataatatatatttaatacatacgtccgggtgcagtggctcacacctgtaatcctagcactttgggaggctgagttgggtagactgcttgagccaaggagttcaagcccagcctggtcaacatggtgagaccccatctctacaaaaaatacaaaatacaaaaattagctggtcatggtggtgtgcacctgtagccccagctactcagaagactgagatgagaggactgcttgagcctggaaggcagaggttgcagtgagccaagatagtgccactgcactccagcctaggagacaaagtgagactctgtctcaaaaaacaaacaaacaaaatacattcatatagagagagaaaaagagggagaattttataatgatatgcatgaggaatgtataggggaagaggctaaaaataggccgaacttactagtgaatatattcaggaggtaggactgtgattgtttttaagtgatcgagggaaaatagtgtactgattttaaaatggaaaactcaacttattttttaaaaattaaaactctgacaagagggaggtttaattgaaatcacagtggctgctcagggaagtttataaatctcgaactgcaacgactcaataagcatgaattgcttgtgatgatattgacttaatagagttattttttccttaatagaaaacacatcttatcaatataatgttatttgtaaagcatggaaaggacaaagtgctcttgggagaagtagaaagagaatttcactctgagaaacctatttggagaaagctcctcatctctggcttagactttaaaattagttaatagtgtaattagggatagttgtagtaatagtggtattggtatggtagttagagtttaaatgtcacacagaatacccagaccaccttcccccaagtgccactaaacttattcttctaatcaaacctctgctcaagggatgtcttcttcctctcttggaaagctgtgttccttacctcagaaacagccctccataaacctgcccttaagagaatccttggccaggcacagtgattcacgcttgtaatcccagcactttgggaggccaaggcgggtggatctcttgaggtcaggagttcgagagctgtctggccatcatggtgaaaccctgtctctaccaaaaaataaacattaaaaataaaaaaattagccaggtatggtggtgcgtgcctgtaaatctcaactacttgagaggctgaagcagaattgcttgaacctgggaggcagaggttgcagtgagctgagatcgttccactgcactccagcctgggcaacagagcaagactccatctcgaaaaaaaaaaaaaagagagagagagagaatccttaagacacgccttcttggatgccctctggagaaatgtcaagagtagccaatatagtcaccccagtcggctgtggtgtgtgggcctctagtgttttaaggttctaggcaacttagcccctcccaggagatgctgatttacttttctcaaggtgcataaagtctcatcacaccaatatctgaaaaatctcttttcaaagagatgcaggcagccttccagccccatgatgttaatacacagggttaggcagcctggcaagtgcactggggcccccactgaaggatcatctggtttccatagcaacagtccttcctttccacggaggattctatcatctctcctgctcactcaggctttccagaatgaattgttttttgtgactataggtgtttgtccttgatcctgcaaagagaaaagacatattcatttaaaacaaacaccccccaccccgccccgcaactgactgcagctagaatactgcattgcatcagctggtcttcctttcatttaaaaattccatgtcctttctccattttgctccgttctctagctttatccatcattttagaaaacaggtttctctgacagaaaacaaacagatggcaactccatcatcctaaaactggctgtgacggggctctaaaattaagtgttcatggggctcccagaaagcctaggcttgcatggtatgtgtggctgacctgtgagttacgattggaggggcaagagaaggctttctatacacagatggctccccatacagtgtcacagtctctgaagtgttgccttttgaggtttgttttcttaggtcaggcactgctgtcctgtcagtattttcctaaattgccaatactcctgggaagagtaatacgttaggttactaatactgaaagaacttgggaaagagaggagggggtgcagcgggaagggaataaaaggggctctgaagaccacctttgtgtgcttcacagtgacatcttctgcaagaggggaagtgcaggtcttcatctctctctttgtctctctctgtcacacacacacacacacacacacacacacactgcaggatgccttctgacaattacaatacagtagtgaattcaccgaacaggactgttccctgaaacacctacatacaatcccgctggaagacctttgaaacagccctgcagtgactaaaaactctgtccccagtgccacttgtttaaccctacagtttccacagactaaaggtagttttcctttggttaatatgaaaacaccaaatagtcagattgctttgttaaataaagtggattacggtgaatctgttcacttctatgttttatattgccctcactccacaaatcacagaagatatttatttttcccccagttaaattctgttaccacaaccattacaaacaaatgtctatataaccaaaatgttagtcagccccattccaatggagcacattttaagtgatgtttaatgggacataatttgaacataaaattctatctgtgcactgttttcaagtctttgaatcaggcctccacctatagatgttggttacctatcagggagcaacaggtgatgctaaggatcactttgtaaaaaccaggaatcacatccctgtaactgacaggaaactgactatattcatcagggttctccagaaaaatagaactaacagaatgtgtatatacataggaggaaattttgtttaaggaattgactcgtgtgatcgtggagactttgggagcccaaaatctgatgggagaagctggcatgcaggaggcccagggaagagttacagttctagtccacaggtaacctgctagagaattccttcttgttctggatgagtttggccttttgtctattcaggctttcaagtgattggatgaggcccacctacattatggagggcaaccttctttactcaaagtctacagatttaaatgtaaatctcatccaaaaacaccctcacagaaacatccagaataatatttgatcaagtatctgggcaacatggccaagccaagttgacacagaattaaccgtcacactggatcacaagggctgtgttcagcaagaactgaccttggtcaaaccctgcccctgcccttatgccccactcttcttcattctgggtcctgctatttccattttatcatgtcttcatcttctttccccacctttcaggtacctttcctctctgaccctatccctagactcacctcctaccccccactcaaagcccttccttccttaaaaaatgatgttagtcattacactttaggatttaaattaatcattctgttagccgtcttactaactttctcactgtgaaaggaaagcatattaaaagaatttcagggatcgacgaagagctgagggaggtatttttctaggaagagaaagtgactaacagaaatcaagacaaagggggacaatcagatttttcagatgacagaaagcaggtaaactctagagatctagagaactagcaaatggtctcttcagggtgtcatcattgcagtaaatgagctctagctatttctgtctttattcttcagggtattcaagattgcagttacttaggagagacagagcatctgactgattgaacttgggttctgtattcactcctgggccagggggaggcagggtacctggtctgacagtccttccaaggctgcatgaaccagaggagctgttaccagaaaagggcagagtgaatttggggcagcaaaaacatttattgcttatcgactatcactgcaaggattactcagagggtgatgcagaatcagcacccctctatttctaagatgaccttgaatgtcagagcaaggcacaaacaggttgcagagacatgtggagtatctggagcactgtctcaggatccttcctctcctgctggatgctaaggaccttaaggacaagagctatctttgcttgcaatttatttggcaggccctgcagggctgtgcaaatgattctatttaatttttactacttgtgagaaggcacagagggctttgagagggcacagagggcctcttataatgggtagatatgcacattagctgatacactggaaactttccagcaggcatatccttccaagatgataaatattcctccttgttggagaaattgaagacatttgtacttgcaatctagcttatctagtaaaacaagacaaactaaccagtgatagggagaaacatgtttgcattattttccaaccttgaaaataatgtcagattattggactgagaaccaatgtcatcttctggatcttgtaattatttggacaaaatctctttgattctaggttcaaagtcaaggtgtcaaaaaaaaaaaaaggatacaactgttaagcttatttaattatacctctcactgtacaaataaggaaactaggccaggcgtggtggctcacttctgtaatcccagcactttgggaggacaaggccagtggatcacctgaggtcaagagttcgagaccagcctggacaacatggcaaaacgctgtctctactaaaaatacaaaaattagctgggtgtggtggcaggcgcctgtaataccagcgacttgggaggctgagacaggagaatagctagaacccgggaggcggaggttgcagtgagccgagatcatgccactgtgctccagcctgggtgacagagtaagactgcgtctcaaaaacaaacaaacaaaaacaaataaggaaactgggctcagagagatgaaggtacacaggtgatgggtagatagggacaaagaaaagaacctaaccctttggactccccaagccattctaatatttgtttttgtaagttagtagcttctgcacgttagtatgtcagaactcaactagtttcctatctttcctgataacctctccgacccacccatgatttagctaacatctgatttggtcaaccaagcaccctggtcctcaggttcagtgtgagacttaatgaaataggcgtgaatttttttttttttttttttttagacggagtctcgctctgttgcccagcctcgcaatctcaactcacttcaacctctgcctctggggttcaagcgattctcccacctcagcctcctgagtagctgagatcacaggcgcccgccaccacgcccggctaatttttgtatttttagtagagacggggtttcactatattggccaggccggtctggaactcctgaccttaggtgatccacccaaagtgcttggattacaggcatgagccaccgcgcctggctggcatgaattttttcttctgtccctagttcatcttcaggtcactgtctgattttattagttctcaaatttaaatcactatgcatgctcagctcttctagttatttcccttctttcctcatgttgggaaaaaaaccccgatttattctaattgtgagaaatgaaagcgaacaaatcctatcattccctattgtcttgtgcaaatatgaagagagatatgatagtggggtaaataaaagcatcagggaatccattcggcagaatctttctcctctcagcgtgcttgcagttagatattctgagattccagtggagaaatggtatggtggaaacattgaggttcaacaaggctcaatttagggcatattttattcagattctaccatatatattgtctaaaatgaaacaacactggggaatgaaaaggttggtcgaagatgcaagttgcctttattaaataaagacaaatatttaataaaaataatgtataaaaataatcacaattcactttcaaatctgaaaatactgagttttccaggctacacataaataaaactgccaacgatgacaattccagcaactaggaaaacaagtacgcctacaaagaaaagtgagaaaattcatggagaatttgaactcagaaccaactcctcggagctgatcttttttgggggaagccagggaacgcgccgggcgctctcatcagcaagaccatgtttaaagagagtgtggaagcacagaccaaaatggacattcgagggcgaacagcagctggcaaagggataagtgatccgaagcattaaagcccttgagacaaattccggcgcgaaccgccagtgggggatgagactcgcaggcgcagccctccaggccccggcggactgacacgcacgttggaaacggagtcacccaccacagccccgcagctccagccaaaatggcgccgccgctctgcccaccccgcgcaccccaggcggccgccgagcccgcgcgcgcgccctgtggagcgaggacgccggggacgcggccagggacgcgcgcgtcctcacggcggttgcacgcctgcgcgagggcgggcggcgggggcgcgcgcgcggcgggggcgggctttgccgagcgcagagctgcagccgccgagccggacgtgtccgcgaagatggcgggccgggtgagtgccggtctgggagcccaggcttgaggcaggggcgccgggctcgcgggcactctggggtccaggcggccccagaggagtgggagtgaatccgagcaatggggcgcgaggccagagcgggacttgagggtagcaggggagcggtggcaggggattagccctcctcaacaactccacccccctcgaggggagatgacccctcgttacacgcgtctgctgcgcctcccgtcatcctcccttcccatcccttggggcttgttccctcgtcctccacacagccgcagggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaaggtcgttgggaaagaggagggggtgccaatgacttttagtgttaaagcccggccatctgggggacctgtcaactgtcgggtcaggcaggaattggctttagcttggagtgaggatggatttggggtgtcacgttttgtttttatggatgacagtcgcttcgaatgcagcaggatatgctgtagtttcagggttttaaatttacttcctcctttagcctttaggatcgttgggtaggatgggtttggcgaggagagagagctggttgagtgctgtattgcagtctgccttgagctaaaagctctcaagggatgagtcctgcccggagattacactggtcataaacctgaggacattaactgcgtcattgggggcgaaagatgtgattgactgatctatttataacagaatttttgaataagtttgcatagatttatgcatatatgcaaatgccctatctgaagggacttgtaggtcatgagattctagagtaagaagggatcttaaaggtcatttagtttggcttctttctcttccttttccccatggcctctccttttaaggctagtccttctgccagtacttcagaccctatctgtatattcacctgctccttcttaacataatcaagcttctctatcttaaacccttcccccacccccacagctgtcaccttttcccgtcccagtttacagcaggaaatttgatagagttgtctatatttattgtcttccatttgcttaccacctactcacccttcaacctactgcagtctgatttctgccccatcatcccactgaaacctgtccctcaacttaattgatacctttcaatccttatcttatttgatatctcagcagcgtttgacgttgttgaccatggcttccttgacggaaagcactcttcacatgtgttctggaatgcctcgctcctggtttgactcagacctctcttttgcggcctcaccctcctctactttgttattcattgctggtattcctcaaaggccgtcttctcactctcaatttcccgctcaggcaatttcttctaagcccatagctacaactgtctatatgccagtgattctcaatattttacccccagtccagacctgccctttaagtttcaggttaatatgtccaactgcttatttaaaatcaaggtcccgaaacgcagctttttcaactccgaacccaggatcttagcccacctaacttgtgtagatactcctcgacttaacgatggggctaccttccgataaacccattgtaagctgaaagtatcagaagttgaaaatgcatttaatacacccgatctaccgaatatcatagcttagcctagcctgccttccttacacatgcacagaacacttacattagcctacagttgggcaaaatcatctaacataaacctatattataaaatgttgaatacctcatgtcatttattactgtgctgatagtgaaaaacagaatggttgtgtaggtcttcaaagtacagtttctgctgaatgcctatcacctttgcactattgtaaagttgaaaaatgttaagtcaaaccattgtaagtcagggaccatctgtacctatccagtgagataggaatatctcactgaatgataccatcatccacccagttatataggctgggaatctgagggagggagagggtgggtaaccctttatatctctcttttgctgtacccatgtcctctgccctatcccccggtaaaatttgtcagagttctgctcctgccccccataaaggtatttaattagggccaaagactctggtttgggggaatggttgctttagactagttccaagtcacccactggactatctggattggtcacatgggttctgtcattttaacctaaaaatctccagtctgtccacctttccacatcttcatttttacctccttttcccaaactaccatcatttctggtctggactactgcaggaagcttccaagtatttttttgttcgtttgtttgagatggagtttcgctcttgttacccaggctagagtgcaatggcgtgatccctgctcactgcaacttccgcctcctgggttcaagccattttcctgcctcagcctcctgagtacctgggattacaggcgcccaccaccacacccggctaatttttgtatttctagtagagacggggttttaccatgttggccaggctggtctcgaactcctgacctcaggtcatccacctgccttggcctcccaaagtgctgagattcgtgcccggcctcccaagtagtcttcttagagcatgtggcccacctccaattcattcttgaccttcattgttccttcccgtgcctattactacttaaacccctcctcagcagcatcccattacttttgggagaaaaccaaatccttaatgaggccttcaggactctttgtggttctgctcctgcttctttccactcattctcttactctgtgtgctcaggttatatggtaaacgagcctttcaattccttgaacctgtagtttctcttaccacaaggtctttgcgagtggtgtttcctttctttgtaacgttcttccccccaaccatttacctcctactcagacatcacttagctactcaagggaggcctactctgaccccacattataagtcaggatcctttgttatatactcttgaagaactgtattcctctccttagagatttatctttttgttactttgagtgtgtgttattatttgcttctaccacttcacctcagtgaaaagcagagaacatacaagttatttagtcattatcaactgcgctttgtgtaccttgtgggacttaggtactcaatacatttttgttgaaaatgaatcagtctctgaacactctggtgatagatggtatattaccctaaagcttgcctgtaatgtcatacagctatgttaggtctttgttatctggagttccatgtaacttttatacgtagttactatttctgctgtttcaagccatacggaactaaacacaattctttttccatgtaatagctactcaagctactcatttacttgaatacaggttacatatctcctcagattttcgattttgcaagttaaacatcccccaattcctagcatatttcatattccaaacccttcatcatttaggctaccttcctctggaagtaacctaatgttactgttttgtcaacctttcttctaaaatgtgcccagagtggaacacagtgatcagagaagaatgtacttaagctattattgtcttgagatggacactaccattattcataccagataaaattgtattagcgttttttctatagtaaatcacattcttggctcatactgagcttgtagtcagtgaaaactcatgttcttttaaaatcagctccctagctccattctaggtttagagcagttttattgaacctaaatcaagaccttatccttttacaattcatttttttaggtcagtgcatgtctgctgtttgttgaggtaatctggattcttagttctttcatgttaggaaacataatagctgtctcttccagtttggttagatctgtaggtttaatcatgacttctgtttctacgtttgagttattggtaaaggatagaataagacagggtcagaaataacccttggacatgctgccagtgacatgcctctagactgatacccattaatacacttgggcactgttgcttaaatacagatgtgtctcatttaattccaacaaaacaacctgcaaagtaggtagtattatctttgtttttttgcagagagaaagagagagagatttagtaacttgagaagttcacatagccagcaagaagcagggtcaagatttgaactcagatcagcctggtactgttacctagttcaccagcttagttgcaagagtgtagtaaagactaggtttacctcacctagaactttttggacataataatgttcagaaactatcttctaccttttggaaaatctgaaaaactttggcccatctgattgtctatcatttcttctgatagcctttattttctagtaactactgagtgatttttagcaaaaatagttcaccttgttgcaatacttttatttgtgcatatttatggagtacatgaaaatttttttacatgtgtataatgtgtagtgatcaagtcagggtacatgagtccaatgtattaagtatagtcatctactcagctatcaaacattgaatttattcctcctatcactggatcttttttttttttttttgagacggagtcttgctccgtcacccaggctggagtgcagtggtgttatcttggctcactgcaacctctgcctcccgggttcaagcgattctcccgcctcagcctcctgagtagctaggattacaggcatgtgccaccacgcccagctaatttttgtatttttagtagagacagggttttaccacattggtcaggatggtcttggactcctgacctggtgatccacccgccttggcctcccaaagtgctgagattacaagtatgagccaccgcgactgacctcattggatctttttaccttttaacccacttctcttcagcctttctctcccttactccgccttcccggtctctgttatctatttttccactccctgcctccttgtgttcaaattttgtagctcctacatatatgtgaaagcatgcaatatttgtctttttgtgcctggcttatttcacttaagagaataacctccagttccatccacattgctgcaaatgatatgatttcattctttttatggctgaatagtattccattgtgtacatgtatgacatcttctttatccattcatctgtagatggacacttaggtggttgattccatatttttgctattgtgatagtactgcaataaacatgcaagtgcagctatccctttgatacattgatttcttttcctttgtgtagatacccagtagtgggattgctggatggaaggtaattctatttttagctttgagaaatctccatacagtgttccttagtggttgtactagtttacattcccaccgacagtgtatgtgagagttcccttttctctgcatccttactaacatctgttactttttgtctttttaataatagccattctgactggggtaagatgatatctcattgtggttttgatgtgcatttctctgatagtggtgtggaacatttttccatgtcttcttttggccattgtatgtcttcttttttaatgggattatttgttattttccttttgagttgttcgagttccttgtatgttctggatatcagtcctctgcttgatgaatactttgcaaatattttctcccattcaacaggttgtctcttcattctgttgattattcttttgctgtgcagaagctttttagtttgcttaagtcccatttgtttagttttctttatgttacctgggcttttgatgtcttaatcataaattctttgcttacaccaatgtccaggagtgttttccctagactttcttgtagtatttttatagttttgggtcttaaaatcttcaatccattttgagttgatttttgtatatggtgagagataggggtctagtttcacacttctgcatgaagttatgcaattttcccagcatcatttattgaagacagtgtcctttccttagtgtgagttcttgtcagtgttgttgaagatcatttgtctataattatgtggttttatttctggattctctattctgttccattggtctacatgtctatttttataccaataccatgctgttttggttactatagctttataatatattttgaagtcagataatgtgatgtctgcagctttgttctttttgcccaggtttggtttggttgtttgggcttttttctttttccttttttggtcccatatgaatcacattggtattttgatagggatttcattgaatctgtagattgctttggcaatatggtcattttagtgatattaattctttccacaagcataggatgttttttgatttattttctttcattggtgttttgtagttttctttgtagagatctttcacctccttagttaaatgtattcctaggtttttgtttgttttcggtagctattgtaaatgggattgccttcttaatttctttcttggctagatccttattgatgtatagaaatgctactgatttaaaggttttctaaacctacagatatataatcagcaaagagacaatttgactttctcttgtccagtttggatgcctttcatttctttctcttgtctgattgttctggctaggatttccagtactgtggtgaataggagtggtgaaaatgggcatccctgcctcattccagcttttagaagaaagatctcacctctcctcattcagtatgatgttagctctgggtttgttgtgtatagactttattattttgagatatattccttctatgcctaatttgttgagagtttttttaatcatgaagggatgttgaattttatcaaatgtttttgttgttgttgcaatactgttttttttttttttttttttttttttttttgagacagagtcttgttctgttgcccaggctgtagtgcagtggcgcgatcttggctcactgcaacctccactcactgggttcaagcaattctcctgcctcagcatccctagtagctgggattacaggcctgtgctaccacacccagctaatttttctatttttagtagagacagggttttgctatgttggccaggctggtctcgaactcctgacctcaagtgatttgcctgccttggcctaccaaagtgctgggattacaggcgtgaggcactgagcccggctgttgcgatactcttaatgggttttatatttcctttttgtgggggacagtttattttgcattcttactacttttgatattctgacatcatcttataagtgggatttatattcactatgtaattgaagttttttccaatgaagcaccgtatatagtttatctgggaaattggctgaagaataaaatgtgtgatgttattcagtgtacagtttctaggtcatcagaagataccactaccttcccactactggaaaagaaaaaagaaaagttttccacagtgcctgaactgttttgtatgcttatcttttaaaattgccagaaatctcacttactggagattcagcagtccctttctgaaaatacacatactttagtgcaaataaagccagtggatctctttcttcataagtccttaaacctagtcgaggtcatctgtttggcagagataggagtaagataatgtgaaataggaaccaacgagagagaacttgcttaggagttgaaaggggtatggaaagatgttagaggtaaaatttgtcgaatctagtgttttgactagggcaggccagaatattcagtatcagtatcaatatcagaagcttttgtagcctttgtttagaaacctagtcatttataacattttgtgggtgaatgacatcattaccaaacaaactttcagatgaaactttggaactcaagctgtaaattgtggatagctcatgtgcagtactacaaatcaaaacaaatactataaagtgtttggtagtccatttcctgaatgaaagtttgtccaaagtatatcaactttctgcagtcttacatgcagtagttattagttttgtgtatcgctttagtggatatttttaaaagtatcttcaaatgcaatgaattttaggaaacaaaacaattctttaaagcatcattagatagcttcttctttctgaaacccagaggaatttatgtataggatgactctttttttcaagtagttaagttaaggtgcaaaagtataaggtaaagtatattatcttaccattgaaaattttggcagtggcagaagagcgaacccttacaaataccttcattgggcaatacactaagcacttgctgtaatgctttttaaaacatctatactctggctgtggtattttaagtgaaaatctctcagtgagatactctttcgtattttagtactgatatccttaatattgctctgagagctaccttatactgacttcagtttcctagtgatttaaactactaatttccaacttatttttttttatagtgaaaactaaatattccttttgtagatgtaaccatttctggaagccctaagtatttttgaatgagtataattcatgcacactttaagagatttcaagcatgacaagtacagtgaataacatatatccatgtgattaccactgaggtttaagaaatgttaacatatgatatctgcttcagatatttatctttttaaaaatagaacattacagctgggcatggtggctcacacttgtaatcccagcactttgggaggctgaggctggtggatcacctgaggtcgggagttcgagaccagcctggctgacatggagaaaccccgtctctactaaaaatacaaaattagccgggcgtggtggcacatgcctgtaatcccagctactcgagaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctccttttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgtgtgtctttaaaatgtatataatggttttatgctatatctttctttctgcaacctgcatttttcacttaaaataattttgaaatttagtcctgtggatatatagtgagccaattaattctgcttagctactctgtagtctgttttgtgaatataccacaatcatctactttcttattagaggacaatttaggcagttccaattttatttttcccggaatgtacattattttagtcgagtgccattgccacattagcgatattttggttagtgagggactgcagataggaaggtgatcccaaaagattataatgccatatatttactctacctttctatatttacatatgtttagttacacaattacccattatgttacagttgcttacagcatttggtgctgtaacatgctgtacaggtttgtagcctaggagcaataggctataccgtataggtttgtgtaagtacgctctatgatattcatataacgatgaaatcacctagtgacacatttctcagaatgtatccctattgttaagcaacacatgagtgtgtgtctccatgcatatatgtgtaagagttagcatgtgtgtccagaggtagaattgctgggcgataagtcatactcatctttacctagttatgccagtttatactgtcactagcagtatatgagtacctgttatttatatcctctccaacacttaatattgctgacattttaacttttacaatataataggtgtaaaactattgtttaaatttgcatgttgtcctcattactagtgagattaagcatttttcatattggtcattgggatttccccttctgtgaattacttttgtatatttgctcattttttctgttgggctgtgtatttttttagtgatttgtataatttttcgttttttggggggtagggtatgctttggattctaatcctttgttgtaaatagcttctctcagacagtgatggtcttttcatgatgtttatagagtgttggatttaaattttatagttataattaccctttttttttttttaccttggtgatttgtgcttttatgtgtttttcaggaaatctttctccaccctgaagtcattttcttataaaagttttaaaattttgccttgcacattttggtgattgatcaggaatttatttttgtgtttggtgtgaattatgaactaattttatcttttccatatgtataaccagttgtctcaatatcatttattgagtccatttttttcctttactgatttgcaatgctatctctgtattatatccagttcccatatacgtgtgggtctaagtgtcgactctattccgtttcataattctttttgtccatatttgcatcaataacactgttttaattgctgtagctttaaaattattcttgttatttcatagggcgtactttcattacctttcttaatttggcatttcttggctcttttccgtatgaattctgggaacaacttaatccccactcctttaaaaaaaaaaaaaaagacactttggcctggcatggtggctcacacgtgtaatcctagcactttgggaggctgaggcgggtggatcacttgaagccaggagttcaaggccagcctggacaacatggcaaaaccctgtctctaccaaaaattagcgggcatggtggcacacgcctgtaattccagctacttgggaggctgaggcatgagaatcagcttgaacccaagaggtggaggttgcagtgagttgagatcgtgccactgcactccagcctgggcaacagaacgagacagttttttgtttgtttgttttaaagacacttttaaccttccgctatggatttttgacctacatttttcctcttgtattttataagagtagacacagagagcacttcaataaaattcagctcaataactttattaacctgatctccttttctttgactttaagctgaaagtgttaatttctcacaacttgtgctctatagatttgaaaccaaatcaattagcatcagctgtttatgagtaatgcagggtattttggtcttttgctaaattcagaaagaaatgttaaagtgctgatggatttgcactagctgtatagatctttggtggaggaggaaatgggaaaattattaatttcaggtaagaagtcatttttgaaatgcaagattcatttctttttaaaatcaccacataataaaaactttaagggctgcattggtgggtttttaaaaaaaattgtgaagtgtttttagtgttatgtgctgacaaatatttttgtagttgctttgacaagcaatgaaactaccaattatcactaattctgagtcttccaatgaacctctgtgtcaaatttttaaatttaattatcctatttttctcctagagaataatattgatataattttgtgaaccatagcagacagttcccattgctgagaatagagcctggtgtggggatattatgattcttgaatggttgaacaagacatttgcttctgaacatcttagtaaattatcacttctgacaatgtctgtagtttgaattttgatattctctgccaaggtattgaatactctaaataatgttgtttattctattatttaaatcattagtattatagatctagctttaaacagctgctgcactccagtcctttttcttcacctgcagatattgagtctgataactgttttgtatacatagcctttcagtaaatctacttatcagtcatcaaattaacttaattataagttaaatgatgagatggaccaagagtgttattgaaatctcatttccacacatttcttctcttcttttgtagaaggtaatgaaatgaacctgtcagtgttcctgtttttatgaagtttatttctcttagtacagtgattctgatagtgggttctgcagaccagcaaattagcattatctgagaacttgttagaaaagcaaattctcagttcccacttcaggctgactaatttagaaaccctggggtagggcttagcattctctttcaataaattctccaggtgattctgatgtatgttaaagttgagaagcattcacttagtgttttgagctctccaatttagttccttataaattgttgaagatattttttccagatttctttccaaatatgtgctcaaccttgttactgataggtttcaaggttatcgtcttcttcccattaataccttcatctatatccaattttcaaacttttaagaaagcatggctattttgctgcagtatggtgaattaggtactctgactgaccttcccagataaacaatttaaaattctagataatttttttttggagggaggacagggtcttgctccgtcacacaggccggagtgcagtagtgtgaacatggctgactgcaacctcgacctgttgggctcaagcgatcctcccacctcaacctcccgagtagctggggccacaggtgcacaccaccatgtccagcaaatttttttattttttgtgcagatggggtcttgccttgttgcacagactggtctcgaactcctgggctcaagcagtttttccacctgggcctctcgaagtgctgggattacaggtgtgagtgactgtgcctggcagatgaaatattttttaagtaaaaaccttatgtgcatggagatagctggctgaaaagtaaggaataatcaggccaaaaactatgtgaaggtgaaaacccagagatataagccaagtactgctgccttgaggacattatttgcaaatgacattacttggaaaacctagttaacttgtgcttgtgcctcaagaagctcagagaacggaagataaaagtagttttctggtagaacgtcccacctctcctggtaaagatggtaccccaagggtctatacatcataataaatgagaactagtaataaacgtaccttgtctaaggatcggaaagaaaaatttcctgcctcaaactttggtggtgatgggaagggtacagaaattccctgagaagttttacccacaagctgaccttcatgcaggtttgaatcctgattttatattacctggatggtatgaaaatcttaagccagtaattaaatataaaagtggtacaagagtgacgatgccttaaaatgcctaagaatgcctaaaaagcagcaaatacaaagcttcttgggagaacccatcttgatcttaggatttagaaaattcctaaacataaagctgtaagaaatatgaactcacattcacaaaatgcagaaagaaataagatgcaatgaatgagaggaagcagaaacaataaagagcagaatcagaacctgcaaagagttcacatattggagttagcagacacagattataagtacatatatttaatatgcttatagaaaaaaagaaatttaaaataggaatgaggagcaagtatacaaaaatgaccagtgtacaaatttaataacagattagacacagctaaagaaagatttagtaaagtggatctgaaaaaattgcagtatagaggcaagaaaatgaaaagtaataaaagagttaagagaatacagagggtagaataagaaggttcagtctagtcagaattctggggcaggggagcaggggcatggaaaagaatgaggcagaggcagtatttgaagagataatgacagagaactgatgaaaaacaacctacaaatttaggaagctaaagaatcccagaaaggataaaaagaaaaaaaattcacacataaacattttttaaagaaactacatgataccatagagaggtcttaaaagctgtcagaggctgggcatggtggctcacgcctgtaatcccagcactttgggagcccgaggagggtggatcacctgaggtcaggagttcaagaccagcctcaacgtggagaaaccctgtctctactgaaaatacaaaattagccgggcgtggtggtgcatgcctgtaatcccagctactcaggaggctgaggcaggagaattgcttgaacctgggaggtggaggttgcagtgagccgagatcgtgccattgcatgccagcctgggcaacaagagcaaaactccatctcaaaaaaaaaaaaaaagctgtcagagaaaaaagatattaccttcaacaagtatttggctgtcagctgttttcctgtctataataatgaaagccataagacagggagtaatattttccatatgcttagagaaaataattgtcaaccaagaattgtatatcttgtgaagaatgggggcaaaattagacactttaaaacagacaaacactcaatgttgtaaccatcaaaccttccctactagtggaaattcagatcaatttcctgaaggctaaaaaaaaaaaaaaaaagtgaccactgatgtaaagtctgagatttaagaaggattgaagagtaaagaataatggtaaatctgtggatatattgaaataaatattggctttataaaatgatgtatgcggaggttttaaaaatagaactaaataggccaggtgtggtggctcacgcctgtaatcccagcactttgggaggctgaggtgggcggatcacctgaggttatgagttggagatcagcctgaccaacatggagaaacctcgtctctactaaaaaaaaaaaaaaaaaaaaaaaaaaattagccgggtgtggtggcgcatgcctgtaatcccagctactcaggaggctgaggtaggagaattgcttgaacctgggaggcagaggttgcagtgagccgaaatcacgccattgcactccagcctgggcaacaagagcaaaactccgtctcaaaaaaaaaaaaaagaactaaatatatgataacaacatccaaatcaaaagagtggttaaagtattttatgatctttatactgttgaagagaaaggtaaagctattcaattaactttagattttgataggtatgtgtattagtattttcagagtaactactaaaataatataaatattaggaataatttatagcagaaaaaacaatttttaaaaggcaaggaagaagtgaaaaacatagaaaaggtcagataaagaggaaacaataaaatatagaaatcaaatcaaatatatggtagactaaatgcttcattcagacaaagaatgtcagattggattatttaaaagcaagcaggccgggtgcagtggctcacgcctgtaatccgagcactttgagaggctgagacgggtggatcacttgagatcaggagttcgagaccaccctggccaacacggccagctggccatggccagctaatacaaaaattagctgggtgtggtggtgcacacctgtaatcccaggtacttgggaaggtgaggcaggagaatcacttgaacccaggaggcggagattgccgtaagccaagatcatgccaccgtactccagcctgggcaacagggtgagactctgtttcaaaaataaataaataaataaataaaagcaagcaaacaaacttactgaaacaacacaaaatccagctataattttcaagagagatagctaatacatatgaatgtagaaagatagaaagcaaaaggatggaaaaagtctatcaggcaaactctaaccaaaagggaggtaaactaactatattagcatcagacaatatgatctttcagacaaaagagacagctagagataggtccctcaacaatgagaaaaggtttatttatccataaaggtaaaaacaattccaaacttgtgtgaacctaataattgcctcaatatacaaagaacaaaatgacacaattataagatgaaatagacaaatctaccatggtgaggagtttcaaaactccctaattgaaaaattaaaaagacaaaatggttacagctgaaaattaaaattaaaaattcattttctcggttgcaatagccatttttcaagggcttactagtgacatgtgacaatggctgctgtattggacagcacagaaagtacttttgcactgcattaatttagaagacttaatataattaacaatattaataattgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaaaaaagtgattaattggatttcatcaaaagacactgacttagtttgcttaggctgccataacacaatactatagacttggtggcttaaacaaaagaaatgtattttctcacggttctggaagctggaagtttgggaccggggtgccagtatgactgcgttttggtgagcactgtcttcgtgacttgcacacaggcttcttgccacgtgtctgtgtggcggagagacagcaagatctcaccatctctcttccttttcttataaggccacagtcttgtcagattagggcccttcgcttatgacctaatttagcctcaattatctcccaaagtccctatctccaaaatagttggggtgggggaagcgccttgactaatgaattttgttgggggcagtggggagtgcacatttcactccatagtagacaccattgaggagaaagaccagagtggaagaaggtatttgaaatacatgtatttgacagccaggcacggtggcccacacctgtaatcccagcactttgggaggccgagccgggcggatcacgaggtcaggagatcgagaccatcctggctaacacagtgaaaccccgtctctactaaaaatacaaaaaattagccaggcgtggtggcgggtgcctgtagtcctagctacttgggaggctgaggcaggagaatggtgtgaacccaggaggcggagcttgcagtgagccgagattgcgtcactgcactccagcctgggcgacagagcaagactctgtctcaaaaaaagaaaagaaaaaaagaaatacatgtatttgacaaggacttgtacctggaatatataaagaactacaaatcaagaataaaaagaaaggacagaaagccaatggaaaaatgaacaaaggattcaaacagggatttcacaaagaacttacctgtaacgtatgttaaatgctcaacctcattagtcatcagagaaatacaagttaaaacctcagggagatattactacacacccaccagaaagttaaattaagaacacatttgtcatgacaattctgggtttgattttgttttgttttttgagatggagtcttgctcttgtcgcccaggctggagtgcagtggcataatcccagcttgttgcaacctctgcctcctgggttcaagtgattctcctgcctcatcctcccgagtagctgggattatgggcacccaccaccacgcctggctaatttttgtattttagtagagatggggttttgccatgttggccaggctagtcttgaactcctgatctcaagcgatccacctgccttggcctcccaaagtgctgggattacaggcatgagcccgcgcacctggcctgtcatgacaattctaagtggtgatgaggatgtgcagcagctggaactgatgaaaatgcatgagcacaacctctttggaaaactagcagaattccctaaaactgaatgtaggcatgatgcccatgacccagcacttatagtcctgggggtgggaggagtgaatatatttctattcatgatttctatctctgatgacagaaattaagctagtgggtatctgtggttgagtagaaggatagtgactaggagcgggcagtatgggatgctggtaatgtcctcttgacctaactgttggttaccctgggtgtgttcacttgtagaaattcattgagccaaacacgtacaatgtatgcatttttgtgtatatatgttcttcttcaataaaaacttgatttaaataatgttctttttcttaaactgggtagtaggtttatggtgttttatgtgttgcctgtgttttatacatattttattcctgttcagtgtccaaaaaatataaaaagtagtcactgctttgttgttaatttgagcatctcctgcacctagcacagtgcctgggacattatagatatttattaaatatttgttctatggaaaagaagtaggctagtaatttctttttgctttccaacagccagtttttgattcaattatttgtaaatatgatttctactcagttgtttctaaataataaaatatgtaaatactattatgtttatatttattagtaagctgaatttattaaatgagaaacctctcaatattaaggacacatcataaattattagcatgctgtgttataatgactaaaagtagtatcaacaatttagataagtatagtgtggccttacggatgtaagtccgtaagatcatgcagcattgaagatgtgcagtttactagatcttctaatattctcgggtgtctcactgtttcttttttcttttttttttttttttgagatagggtatcactttgtcacccagtctggaatgcagtggcgtgatcagggctcactgtagccttgacctcctgggctcaaacctctcaccttagccccctgaataacggggattactgatttgtgccaccaagccaggctaatttattttctttctttctctctttctttctttctttctctctctctctctttctttctctctttctttctttctttctttctttctttctttctttctttctttctttctttctttcctttctttctttccttctttctttcttttctctctttctctctctctctctctctctcttcctttcttcctttctttttgtagagtttgggtctcactatattgcccaggctggtcttgaactcctggcctcaaatgattctccctccttggcctcccaaagtgttgagattatagttttcagccaccgcacccagcctcactgttttcttcagttgtttctgaacaactggaatctcagctgtctttttccattaaatcccgtgttcgttcctccataccatgctgcctcttgcccatttttgcatttctcctttctgctttcctgaacattctgagtcttactgggctggcattcccttgttgggacaggggagaggctctaggccttggatccttgttctgattccttctccaaagagttttccctttttcttcccctttcaaaacaacataagtgcaaaagctttgtcaggatgttgggaattaaaaaagcttcagaaacattttgattcatttaacaacattactctgaaactttttagagtaagagtaccaagtcactgaataagacgatcttgaaattaaacgatattttacagttttaaaaacaccttcacagatcttttcttattagattctcagcacaaccttatgagttggcactgtcaaaattcagttcaacaaacaaaatccaactaacaggaaaactcacagctaacatcatacttaatggttgaagactgaaagctttcccccttaagatcagaacaagacaaggatgctcttgccactcctattcaacactctattggtggttctaggtggggcagttaagcaggaaaaagaaaatacatttatatcagaaagaaataaaactatatttaccgatgacatgatcttacatgtagaaaaatcctacagaatttaccaaaaaaaattggaactaataaatgagttcagcaaagttgcaggatacaagattattatctaaaaatcagttgcattcctatatgctagctatggataatctgaaaatgaaatagaaaaaattccatttataataacatcagaaagaataaaatacttatgaataaagttaaccaaagaagtacactaaaaagtacactaaaaaacagaaaacatgttgaaggaaattagagatctaaataaattgaaagacgtcctgtgttcatggcttggaagacttaatattgttaagatgacagtgctacccagatttatctacaggtttaatgcaatcactatcacagttcaactgcctttttcccggaaatggacaacctgatcttataattcatatggaattgcagagccatatttgccacaacagtcttgaaaaaaagagaacaaaattgtaggactcatacttcctgatttcaaaacttattacaaaactacagtaatccagatggcatgtcactggcatgaggagagtcttgtaaaccaatggaatgcaatttagagtccagaaataaacccatacatttatggtcagttgattttgaccagggcgccaagatcattaactggggaaagaataatcttttcaacaaatgttgctggggcaactggatatctacatgtaaaaaaataaatttggatccctgcctcacatcacatatgaaaattaactcagaatggatcaaagacctaaacctgttaagttcttcgaaggaaacataggtgaaaatctgtatgaccttggattaaatggtgatttttaaagatataacacaaaaacacaagcagtgaaagaaaaaggtagataaactggactttgttaaagttaaaaactttcatgcatcaaaggacactgtagaatgaagacaactcacagaatgggggaaaatatttgcaaattatatctctgataagtatatatattttatatatatgttgtttatatccagaatatgcaaagaaccctttcaactcaacaaagataagacaatggaatttaaaaatgggcaaagcatttgaatagaatagacatttctccaaagaagatgtacaaatgacctataagcacatgacaagatcttcaacatcatagtccatagggaattacaaatcaaaaccacaatgagagataacactttacaccctctaggatggtcatacttttttttttttttttttaaagacagtaacaagttttgataaggaagtagagaaattggagccctcattgctgatgggaatgtaaaatgatgcagctactgcacaaaagttttgcagttccttaaaaaactaaacatagaataactcagcaattctactcctgggtatagacccaagataattgaaaacatatgttcatacattaacttgtacatacattaacatgtggcattattcatagttgccaaaaagtggaagcaacccaaatgtccatcagctgatgaaatgataaatacaatgtggtatatccatacaatgaaatcttatccagctgtaaaaaggaatgaagaagccaggtgcagtagctcacaactgtaatcccattgctttaggaggccacgatgggaggattgcttaaggccaggagttcaagattggcctgggcaacatagacccagtctctacaaaataaataaataaaaagaatgaaatactattacgtgccacaacatgaaccttggaaacattatgctaggtgaaaatccagtcaccaagatgacgaattgtatgattctgcttacgtgaaatgtccacaataagcaaattcatagagacagaaagtagattagtggttgagaaggagtgagagaagggatgaattgagattaacggctagtagggacagagtttctttttggggtgatgggactgttctggaattagatagtgattatggttgtacaacatagtaaatatactaaaaaccactcaaaggctgggtgcagtggctcatgcctataaccccaacactttgggagactgaggcgggaagattgcttgaggccaagaggtcaagaccagcctgggcaacacagcaagaccttgtttctacaaaaaaaaaaaaaaattgttttaattacctgggtatggtggtgtgtgcctgtagtcccagctactttggaggctgaggtgggaagatcacttgagcctgtgaatttgaggttacagtgagctgtgattgtgccactgtgatccagcctgagtgatagagcatgaccctgtctctcaaaacaaaaccctccaaaaaacaaaaaccacccaagtatacattttaaatgattaattttatgtgaaatatatcagctgggcgtggtggttcacacctgtaatcccagcattttgggaggcagaggtgggcggatcacgaggtcaggagatggagaccatcctggctaacatggtgaaaccccgtctctactaaaaatacaaaaaattagccaggcatggtggcacatgcctgtagtcccaactactcaggaggctgaggcaggagaattgcttgaacccgggaggcagaggttaaagcaagccgagatcatgccactgcactccagcctgggcgacagaacgagactctgtctttaaaaaaaaaaaaaaaaaaaatctcaaaaacggcaatgagaactcaattaatatttatcatactgtatattccctgagtggtgcaggagaatcagagcttagaatcttgtgaggaaggcatggtacttaaataagtctagtgtaaggcagcttgtaataagtagtactaagactgctgaagaagcacaaataaaggagatattctatcttactaggaaccagggagtttcacaaacttggctttgcaaggtgggaaagattttcacaggtggaaggggtttgaaatagggaattcagtcaaaaggaatagtgtgagtgaaggaatggagtttggaatgtggggtacatggggttggggtggggtattgaggtagatgacgcagaaaaataagttaaagatagatcttgcataggtggctgtgagtagcatgctaaggagtttgggctttattacttatgaatcatatttttggtttcaggtcatgtctggtggcagagggaaggctgaattggaggagaacaaaagctagaaccagggacaacaattattaccattgtagttttttaggagaggtgatatggctgaactaggttatggttgtgaggctggaagggaggcacatccacgtgacagtgcagtagacttagtagactcttgattgtttatgtgtgcattccagggataggcagtgaagggaagaatgaccctgaaatcttgaatttaatgacttgaaaggataatgatggtattaacagatgaggaacatagcaagacaaacaaatgaaaaagtgaatactgaggagaaggaggtaccactgaatttggcatttagtcattggtgattttgaagacagcagttacagtaaagtggctgctggaaaggatttcaaagaatggttgaagaagatagccataggatgagaacatggaaggcaaggaagggagacttgagagatttggtaataaagagaagagagaaaagggtgctagtttgaaatgagttaaaagaactacagagtagaattaaaataaagtagaattatgggatttttgctttttaagtgacccatgagaggcttactggcagtgtgccaagattcaagagagcaaagattggcagggtgggattaagtgatgggatagccgggtgcagtggctcatgccggtaatcccagcactttgggaggctgaggtgggtggatcacttgaggtcaggaattcgagatcagcctggccaacatggtgaaacctgtctctacaaaaaatacaaaaattagccgggtgtggtggtggttgcctgtaatcccagctatttgggaggctgaggcaggagaattgtttgaacctgggaggtggaggttgcagtgagccaagatcgagccactgcactaactccagcatgggtgacagagtgagactccatctcaaaaaagagaaaacaaaaaacaaaaaaaaacgacggtagggagccttctgcctctttaaacatttgagatgcatgtcctgagatgcttctgtgaagttaagaatattaattttttgatacgaatctgacaaaactagacatcaaaatatgccatatatggtaattaaaacaatgtggtattagtatagaaagcagacaaatagttaatgaagtagaacaaccaacccagaaatagaaccagatacacctgaaaacttcatatatgaggtttaaaatcagtgtggaaagctggaaatcacccatagtttcgttatccagtcagttgtttttcacattttggtgtgtttccatttagttggtttgccatacttttttaaaaataatgctttaaggctgagcgtggtggctcacacttgtagtctgaagcaggcagatcacttgaggtcaggagttcgagaccagcctggccaatctgatgaaaccccatctctacaaaaaatacaaaaattagcctggtgtggtggtgcttgcctgtagcctcagctacttgggagactgaggtgggaagatggcttgagccagggaagcaaaggttgcagtgtgctgagatggcgccactgcactccagcctgggtgataaagccagaccttgcctcacaaaaaaaaaaaaaatgctgtaaagtaaaagttctgtatacaattctgtgatatgaaccctaccttagtgtgttatgaggattttgatccttatatgatatgatatatataatcaagtgcgggtacgttgtagtttacagaaccattactttgaaacaagacctttaggttactcctaattcatcactgttaaaataatgctgtagggaaaaaattacacataaaagttttctatatttaaaatgatttttgtgagacaaagtttatttattgtaaaaacagttccagcagttcagaattgtaaagagttttacagaattgtaaagagttcagaattgtaaagacattttcttgtctttctccttggtggtaaccactgttaacagtttagtgtgtatcttttttttaagtttagtttttatttttttgtagagacagggtcttgctttgttgcccaggctggggtgcagtggtgtgatcatagctcactgcagcctcatactcctgggctcaagcagtcctcccacctcagcctcccaagtagttgggactaccggcatgtaccaccacgcctggctaatttctgtatcttttgtagagacagggtttcaccatgttgcccaggctggtctggaactcctgggctcaggcgatccccctgcctcggcctcccaaagtgttgggattacaggcatgagccactgcacctggactagtttctttttaatttctgagtagtagtcaattgtatggctctcctataatttcttcattcattcatcttttggtagacatttgtgttgtttccatttttaggctattatgagtacagctgttgtgatcatttgtgtgcgagtctttgtgtggatatattttcatttcttttgactaaaaacctaggggtgcacttgttgggtcacattaactttgtagaaactgcattgcatctttgccgatattgaaagttgtcagcattttatatttttctgtgcatgcttttccccccaaaagaccaaaatgggaattgtttttcttttcattataaacttgtaaaggaattttaaagttctaagggatgccaggcaggaggttcatctatgtgaacagttattagtttgagatagataatgtcaaggatatccctaaaggcttttcaagagataactataggacatctaccccatcacttctagtcacatgtgacttcagaattttaacagaaattattattataggaatatgtagcacagagggattccataggcctgaagattagtactgatggcctttcttacattattctaggctggtgctatccgatgaaactttctgcagtgataaccactagccacaggtggcttttgaaacgtagggctagttcaactgaagaattgaatttaactttaaattaatttgaatagtgaaatatgtctagtgattaccgaacagtgtagttctgaaatgttatttttcaggaaagatcctctagcaagaagtagttgagtgagacctgttagctgagctggccctggggcaggtttgtgttttcagtccttccctttcctgtgggagaaatgaaaccaaagcctagagcaccacagaagaagaaccagtggattcataagggtgacagttcaggtaggggaagctgtttggtaatgagctcttttggtcagatgccacactatttttctttctgtttattttgccctattaaattatttagtaaatagtaaagcgtactttaatccagtttttaaagtggacgtttggatgaaagtatgtgatttaaattccaaaactgtgcagtgttgtccagaagagtcctgattaaatcaccccagtttctttgatgaagataagcaaataattttattttttgctgtaatcccagctactcggaaggctgaggcaggagaatcgcttgtaccagtccggaggctgctgccctctcacagggcttcctcctcttgcacagacgcaccagtgccttcagccccactggtctccctcttctcctttcctggcccctgctggcccagtagatgggccactggaggccactagatggggactggggaatgtgatgttggcgatctgcggtatcttcagggtgacagccatacccaacgcgtgggacctggcttccacatctatagacctgacctaaggaaatatgtgggcgtgtgcataaggatgccatctcagaactgcatattaataaaaagctgaatcaaacagtgtccaacaagggtggctgttccagctggtcatctacaatctcagctcactgcaacctccgcctcctgggttcaagcaattctgccttagcctcccgagtagctgggactacaggcacacaccgccacacccggctaattttttgtattttagtagagatggggtttcaccatgttgcccatgctggtcttgaactcctgagctcaggcagtcctcccaccttggcctcccaaagtgctgagattataggcgtgagccaccgcacctagcctgtactttcatttcttaataactgcatgactgtagtggttggctttcattattgtttcctaggggcaaggtcaatgttagaaaaattgtggaattttcccttggcattgctgtggtgagtagacagctactatttatagagacttatacttcgttgaaaaaatgagataccatgcttggcttaccataaaaacacagatgtttctggattccagtagggaggccttttgttcacagcatctgttttggttggccagccagatgacttctgtggattttttcactccttttgaaggacacttgacaaataaacaagtttataaatgaaagagttaacagcattttgtaaatttattttattactttagctatatcgttctgtatattttgaactatcagatcattttagctcaattttatcacttcctaaataaccttgagacgatcagtcctttgttacatgttctttggattgtttattctgcagttgagacagatttttattgatctataaatttttgtgttcaacaaacatttaatgagtattcactgtgtactaggccctgtactaacactgggaactacatatgtgagcaagatatagtctcagtctttgagaagtttagtgtcttatatgcagtgcaaacatgtagacagaataaaattatagttgagtgcttccatttgaagtttatttcatcagtttagtggggaggggtaggtgtctaggaatgccttccagaaaaagtagtgtctaagtggagaattgtagaatgagtgggagttgtccagggatggaacaggggttagtggcggagattatataaaagaaagaagcttgcaggtgaaaatgaccctgggaaagtgggaaactgaaaaagttcagtacatttctgtcatatggctgatcaagctgtgactgggcaaaatgctgtcagcatttgttgaacacataaatgctgtctcattcacaaaggagacttgtgacctagactttattcatcttgtgctaaattagtgatttccaaacatttgatcatgaatctcataagtaaaaaatgttttgattatgtatcctcatatattgattatatgccaatatttgtttatagatgatatgtagtactaaaagttatatacgcagtagaacatgtatagaaaacaaaaaaaattaaaaggatgagctaaagatggcatgtacaatattctcacagtgttaattttactgaaaatacggaaagtaggctgggtgcagtggctcacgcctgtaatcccagcactttgggaggctgagggaggcagatcacttgaggtcaggagtttgagacaagcctgaccaatatagcgaaatcccatctctactaaaaaatacaaaaattagctgggcatggtggcacacgcccgtaatcccagctactcgggagggtaaggcaggagaattgcttgaacccgggaggcggaggttacaatgagccgagatcatgccactgtactccatcctgggcgacagagcaagactccatctaaaaaaaaaaaaaaaaaaaaaaaaacccagaaagtaaagtggtacatcattatttaaaatcttcgtttaatattatgtgatacagctgctcagagggctgtttctaaattcagtttattttgatactttaatggcagtcaaagcctggatcaaaatggaagaatttggctgcactttctaaatcatattctttctttctccaaacttattcactatttatggaaatgctttattgaaatgtggctggtaaatatccatctattagtttttcttgcagattaataaaaatatattatacttttattgtgttaataaatgggttccaaaaatcactgttaagtcttcatttggaagatattttaaaaagttttagaatattctgtttctgactttataaagcatgaagatacgagtttttggtgtctttattttttagattttgtatatattgtttcaacagcagaataacttagcaatggaaatgtttccaattatccaattttgaaatgctctattaggaaagatttttttttctctcgctctcttttttttttttttttttttttttttaaagatgaagcctctctcttgtccccaaggctggagtacaatggtgccatcttggctcactgtaacctccgcctactgggttcaagcgattctcctgcctcagcctcccgagtagctgggattacaggtgcccgccaccacgcccggctaatttttgtattttaagtagagatggggtttcaccatgttggccaggctagtctcaaactcctgaccttaggtgatccgcctgcctcattctcccagagtgctgggattacaggcgtgagccactgcacccggccgatttttttctctttttcttttttctggaaaagctgaaaataattctgacatgttgctaaacatttttattttgtaggggcagagtgagtttttttgtttttttaatatcttcttggtagcatactacttataacctcctcagaaatatttagcaagtttggaactctagtctttttattttaaaaaaattgtgtaactcatctacatttaacaaatcttttaaatacatttcttgtggtaactagtgaatctgtgtggatttaaaaacaaaaaaaagattatgaggccaaggcaggtggatcacttgaggccaggagtttgagaccagcctggccaacatggtgaaaccccatctctactaaaaatacaaaaattagtcagaagtggtggtacacaactgtagtcccagctactctgagctgagaatgcgccactgcattcaattctgggcgacagagcaagactatctctcaaaaaaaaaaaaaaaaaaaaaaattcagtggctactctctatctcccagagtataggaagattctatattcatacagttaacctcagtgacatctgaggtaccttgttctgacttaattgcagcaatagtttacctgtgaatgaagctgttaaaggcttttgtatcagatgctatcactgtaactttgttctggaattttttttttttttgagatagggtctcgctctgttgcccagactggagtacagtgacacgatctcagctcactgcaagctccgcctcccgggctcacgcctttctcctgcctcagcctcccaagtagctgggactacaggtgcccgccacaacgcctggctaattttttgttattttttagtagagacggggcttcaccgtgttagctagcatggtctcgatctcctgacctcatgatccacccacctcggcctcccaaagtgctgggattacaggtgtgagccaccgcagctggccagaattcttttttaaaattccagtcaaagcagtcatttcatcagtggttacagttttcccataaagcaccttgtttcatttacagttaagaatacctcccttttaatacattgttccttggtatcttacaaagttgtatttcctgtatatttcataattacccagcaaataccctaagatgaaagaatcatctgtatttttatccaattgtatagcaaaccccacacactgtatttgtcctgatatcttcaagtctttagggttttctaagagcttttgactatacttaccaataaaagaatacatttagtttgtcaccacttttatttctgtgtataatttcagctatggtccttggctttttttagggaaaccttagcagtttcgacactaactttcgtacaattttgtgaagtgtcacattaaatagcctgtgactttagacataggtggaaaaattatagacgtttaactcttgcagtgaacacttaaaagcctggtggattatgaggactttgttcgtgccatcagattatatcttaaggtagagtagacatgtagagtgaggttcatctttaataaaaaatgggctgggtgcagtggctcacacctgtaatctcagcactttgggagaccgaggtgggtggatcacaaggtcaggagatcgagaccatcctggctaacacggtgaaaccctgtctctgatgaaaatacaaaaaaattagccaggcgtggtggtgggtacctgtagtcccagctacttgggaggctgaggcaggagaatagcgtgaacccgggaggcggagcttgcagtaagccgatatcgcaccagggcagtccagcctgggtgacagagtgagactctgtctcaaacaaattaaaataaataaataaataaataaataaataaatggtgtggctggacgcagtggctcacgcctgtaatcctagcactttgggaggccgaggcgggcggattgcctgagctcaggagttcgagaccagcctgggcaacgtgatgaaacccccgactctaccaaaaattcaaaaattagctggagcatgcctgtaacccagctacttgggatgctgaggcatgagaatcgcttgaaccagggaggcagagattgcagtgagctgagatccaccattgcactccagcctgggcaacagagagagactgtgtcaaaaaacaaaacaacacataaataagaaattgtgtgaagtcaatataaataccagtactaatattttatttttataccccaaaggattatcgtataatacaaacacccttcaagtacacatatcccactttggagactaatgccctaaacaacagggataatgatattgaaactggccttttagttaaaataaaagcaaagccaaaaataattcactttcctctataaatttatatttgggagacacatttaagaataatcgtcctggccaggtgcagtggttcatgcctgtaatcccagcactttgggaggccaaggtgggcggatcgtgaggtcaggagatcaagaccatcctggctaacacggtgaaaccctgactctactaaaaatacaaaaaattagctgggtatggtggcgggcacctgtagtcccagctactcaggaggctgaggcaggagaatgacatgaacccgggaggcggagcttgcagtgagccgagatcacgccactgcactccagcctgggtgacagagtgagactccatctcaaaaaaaaaaaaaaaaaaaaaatcagctttggcttgaggtttgaagaatgaacccttcagtcatagactatgactacctgtcatagctcactaggaaaccctagggaatcatggaagggttattggttaaatatattatataaaggaacattttgctagttgctattgaccaaaaaggctgtttttttttttttaaatatagtctgtaattatttttgttgaaagatatttggaagatggtttttctcaatctataggagatacagttcgtagccacctgggatctcttataaaaagatactttttcatagtatactctttataatatgcataacatttcataatatacttttgataatatacataaaatttgatacataagtttaccaaatttattgaatttacttcagtgcatttttattagtcaagattctttggaagatatggaaagctaattcaaaaaagcttgagcaaaaaaaatttgttggctcgtaactaatgttcaggactggtctcaagaacttggttgccagatctgtgtttccaggttatctattagcttgtctgtgtctctgtgatagttttacccttttagagtggaaaatcttcctccttgtggtgctctggcttgcagaagaatgcctttggtctagcgccagcatatataaaatcctgtgggtgggatagagtagatgtggttgcatgtgtgctgactggcagtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagtgagtatctgactttgttttcttttaacctgctaagtggcattcgggaaacttccagagagtcatttttaggaaacgttggaaaatatttttaaaaaattcttgctgagttggaaaatggagaagatgagaaaaagttatgtatttgaatcattactgtgtcaaactttgataaatactgtataatgttttaaaaatgttttatgtataaaactctagttttcatcagttttcttagtagagctaaacatactggttgtatgaatcatatatggcagagttgttaggtgtttggttctggcaaactcagattgtttgagttttcctggctctaccaattacaaactgtgtgaccatttctgtacctctatgtcctgatctgtaaaatggagatgatctcttcctcaaggtagctatgaagattgagttacataaataaagcacttagaacagttcccaacatgttaacaatcccttagtaaatattagctgttatgattattattaccatgataatccaagagacatgaacattggaagatgggctgggtatggaggcttacgcctgtaatcctagtactttgggatgccaaggcaggctgattgcctaagctcaggaatttgggaccaacctggccaacatggtgaaaccccatctctactaaaaataaaaattagccaggcatggtggtgtgcgcctgtagtcccagtttctcaggagactgaggcatgagaatcacttgaacccaggaggcagagactgtagtgagccgagatcgcgccactgcactccatcctgggtgacacagcgagactctgtctcaaaaaaaagtaaaggaaaaagaaaattggaagctgcaaagcaaatgtagaatccttaaaggcattttgcactgtaatttattttaactgatccatatcaccgcactgccaggacttctaaagaccctgctgcaagttcagtgccatccatatgcttctgagattggtacagataaggagatgaaggggctgtagggaaataagaggcaaggtggtagggttttaactgagcatttttcttaaaatgttatctgtgaaatacctgagtttcacagagttagaaatgctaatcatctttggtttccagcttcagagtaagaggctgtactatatggtgatattaacattgtttccagtgctaaacattctgtgatgctaaattgagcacaggattttcaacagataaactgaagtatagataatcaacgtgagaatttgtggaattcttttacatatgttaaatgttcactgtactcatggtggggttactcaaaatgtagttgatataaggaacatgtgttctagtggcaaaaaaaatacgtatagaaacattagccattgatgtgaaaaattacagcattctgaaaagataatgtttaaaaagatagtgagctaggcatgttagggcatgcctgtagtcccaactactttagagactgaagcaggagaatctcttgagcccaggagtttgaggccagcctggtcaacatagcaagaccacatgtattaaaaaaaaaaaaaaaaaaaaaaaaaaagatactgctgctgcataacaggatttgaagcttctatcttacacatagtactttttagttacctggtataggagattatcatgagaggactgttttttttttttttacaggtaatttctgaacagggaattagcacaaaattttttaaaacagtaaatattgatatctacatgaaagctgatgtattttgggaattttttaaatcttttttttttttattttgtaggttgtttttgttttagcctgttgagagagtctgcaaataaatttaatgagtagtctaaaaactaacttttttttgattgctatatcctagctcttttatctttggctctcttctccttattaggatgtgaagtaattctcaggagaggaaatgcatctagtttttacttgatatcaaggactctaaatcactggcttcagttttatgtaaactggaaatgtaaggaagttggtattttggatggtattttggctggattctacttgatgagtgtttgacccaaggtgctccttatatctggaaaacatttgggattgctgatagtttgggaaactaaatttgtggttctatttcttcaagacacagatagtgtcgtttccacctgatactcattaaatatcagtttgacaagaaatacattttgaaattatgttcttcatttccttcaatgtggagtactaactgtgtttctgtcctttaggcatgtgattgtgaggacctctcccaatcacaggtacacatttacactgaagacacatccatcggtggttccagggagcattgcattcagtttacctcaggtaactcagatgttaatttgttctcttctgtttttgaaagtcatagaatatgaataatctgttcattttaagcaagcatcaccctgtgactgtattgattcatattgaagaaaaatatctaagtattatataaggaatttaaagatacagtcttctttttttttttttcttttttttttttaagacagggtctcgttctgagacccaggctggagtgcagtggcacgatcatggctcctggtctcaagcaattctcatacctcagtctcccgagtagctgagactacagtcttgtaccactgtgcctgactaattttaaaattttttgtagagatggtgtcttaactgtgttgcccaagctggtctttaactcttgggctcaagtaatcctcccaccttggcctctcaaagtgctgggattatagggtgtgaatcatcatgcccaacctaaagacagattcttaattgccagtttttgctatggctgccttcttttggcttgattttttttccctaatttttaaagattttgcagtaaaatcagtcagctatcacataaagcgtcaagttattttaatgttaactgccagggtaatagaaaagtagaaaacattttatttgtgaagttgatatctaagaatggtgattttataatgtgatggcgttatactaaagaatttggaaagagtctcaaattacaacataatttgctaggctcccataacaactggatgggttgtgattacagttacaactgttgatggattctgtagaatccagagaattagattgcttagtgctgtcccaggcacatcatacataatataaagcaccaagaatactagtctgtatcctcttctcccttatcattttactcaggctgctgactgtccccagtcctaagtaatgtaaatggaattcctacctcctcctagtatgctaatgagcattggttgacttccctgaaggtttagagaaagagctcaaacactcatttaagaactattaggctgggtgcaatgactcatgctggtaatcccagcactttgggaggccaaagctggtggatcacttgagtccaggagttcaagaccagtgggcaacgtggcgaaaccccacctctactaaaaatataaaaattagctgagtgtggtggtgcatgcctgtagtcctaacttcttgaggggctgaggcaggaggatcacttgagcccgggaagttgaggctgcagtgaggcgagatagtgccactgtactctagcctaggtgacaaagtgagaccctgtttaaaaaagaaaaaaacaaaaacaaaaactattagatgggccaggtacctcacgcttgtaatcctagtgctttgggaggtggaggaggatcgcttgagaccaagaattccagatcagcatagcgagacccttgtcccccgcactagtctctacaaaaaaaaaattttttttaattagctgggcatggtggcacatgcctgtagtccaggctacctgggaggctgaggttgggaggatcacttgagcctaggaagtcgaggctgtagtgagctatgattgtgccaccatgctccagcctttgctccagagtgagattctgtctcttaaaaaaaagggaaaaaaaaggaactattgaagatctcttgaagccctcaaaaattacaggaaattttcacttactattccacctgtctgtttgatgcctcttcattatccagaccactttcacgtttgtttctatagattaaaagtttgggatattccagggttctccagcttttacagagttccatttgggattctgattgttagcaatagcttgaggtgtgacagtttctccttgtctctgttttgtaaaaaaaaaaaaaaaaatttccccgacattcactgtaggccagcctctattctaggtactttggcatgtgttagctcatttaattctccaaacaaccttatacaatagctactgttgttatccctaaggactgttgtattagtccattttcatactgctatgaagaaattctggagactggataatttataaggaaaaatgagatttcatggactcacagttccacatggctgcagaggcctcacaatcatggtggaaggcgaaggaggagcaaagtcatgtcttacatggcggcagacaagagagcgtgtgcaggggaactgccctttataaaaccatcagatcttctgagacttactcactatcatgaaaacagcatgggaaaacccacacccatgattcagttacctcccactgggtctctcccataacacatagggattatggaaactacaatttaagatgagatttgggtgggggcaaagccaaaccatatcagctgtctttgggattgaagtacagaacctaaatgtggcttccttgtgacttaaagtctaagcttaacgagcatggtgctaaatttcaggttggccagaagtgggatggggttttacagaagaggtcttctgggggaggtgaagggcagagtggagggaaacaggatgtggtaagaaagccacaagggagagcacttgttgcacatattcacagttcagtgtcttctaaattacccgccacaaagtctgcagtgtttggatgggcaggtgaactactgattttcaaccaaaaattgtttttctcattgttctttggagtgttaccagtaattactaattttgaatctataccaagcaaaccccagattcctgcctaaacacaatctggcctgccttcatacttcttgccattgtaaacagtagggatttgggaaagcctgaaatctagctgtaaatgtctaaaaatcttctggctagtatacaaagagtagccatgaccatctaatgatttcagtccctgactgggtttcaaaatagattttctgaccagttttaatttagtcttcatgaattgaatgtcttcctttttgagatactgtaacaaacagtaaaactaactgcagcagtacatttagaacactgaagtgtgatctgatacagtgaagaccttctgtagcatcatattgtgcaaaggaacatcctcctcagtggtgccagctttactgcaaaaggcaagctttgcacgttttgaaacagatgttcagatgtaaactgtagcacatgctttactttcctagggtaagtaacaaagaaccattactgggtagcttaaaacaacagagatttattctgtcaccgttgtggaggccggaagtctgaaatcaaggtgtcagtagagctattccctctctgaaggctctagggaagaacctgttctgtgcttagcttctggtgttgccggcaatcctttggtgttccttggctgtagctgcatcatttcaatttctgcctctgctatcacatgatggcattctgtctgtgtgtctatgtctctttcttagaaggacaccagtcatatcggcttagggttcaccctaattcattatgacctcatgttaacttgatacatttgcagagattgtatttctaaataaagtcacatccacaggtgttgggggctaagacttcaacatactttggagggggagagcacagttcaaccataatagcataccatgttttgatctttgagtgtattcctaaaattcattaaaattcctctttttctcttgtctaattttgatggctttggttttaagtatctttttttctcctttacagagaaaatgggctgggctttctattgggcaagaaatagaaggtaggtatattttttagccacctgataaagattttctatgtgattttctcacagttattgagatctgtacaattttctattactagtggtcagatcttaaacattcattgtatcagaagactggttacatctatgagaatgggaaggaaatagttatggtacctctgttcctatatcttttatgaagtgtgtgataaggtcgtcatagttcaaggcaaggaaagcaatttgtgacttccagttgggggcgtggcggggtggaaagactaagctgctaatagataataagccaaagaactaataagcaaaaagtggcattgtctcaggcaatgtggcaaagttaggaaatggagtatgagtcgtctttagtcagatgattttatgtcaacttcatggatacagtaggggaaggaaagaaaatgcaagtgtaattaaaccagcttttcttctgcttgtctttaaaacttaaaaaaaaattgtatttatagaaaggttgcaaaaataatacgaagaatttctgtatactgcctttacccagctttaccaattgtcatattttctttatcattctggctccctgtcttcctctctgggtctctgtctctctctgtacacacacacacacacacacacacacacacacacacacacacgcacacacacacacacacatcttttatcctactcctcatttaggaacctgacaacttgtaattttttctaagttagatggaatttaaacattggggttattttattttattttatttttgagatggagtctcgctctgttgccaggctggagtgcagtggcgcaatctcggctcactgcaacctctgcctccagggttcaagcgattctcctgcctcagccttgcaagtaactgggactacaagcacttgccaccacacccggctaatttttgtatttttagtagagatggggtttcaccatgttggccaggctggtctcgatctgttgacctcgtgatccacctgccttgacctcccagagtggtgggattacagatgtgagccaccacgcccagccaacattggtgttatttttagttagctttttctttgtggaagtatgaacacttgttaaatttaatgagaaagtggggtagtatgtagcttaggtttctaattttcataaattaatttttctaaatatgaggctaagagtacttaaaactttgaatctagatattttctattgtgacaagatacagaaattcaagattataaattttgatgagttgagaaatgtgttttgcggtttaagttataaaagcattcttctgctaacagaaatgcttatctggattgtaaagtcagatctttaaagaagtggctcaaacagacttaataagcaaaattgtaaaacccagtgataggtgggactaaagtggagtaagcttgagggaaggtagggttttggggcccaagtgatgtggatgatgtagccataaagatagaaaactggtttggtttaagtagtgatgtagaccaagataggataggaggtgtggtttgaaggagtgctcaagtattctggaatgggagttccgtaaggtgaaacattttagtcaaatcagtgattttagtctgagggaatcttctggaggaatcatttagtcggtcttctttccatctggcaatgccatattttaagtgttacaggctaatgttttgaccactatatatacacctattattgtaaagtccaagtttattcaaagaactggatacacttattttttgcttataaaatctttcttattagtcttttatattaaattactattagccgtaaaataagaaaacattctcaatcttctttgatccaggatgaaatcttcaggactcttgtccctttgggactgaccatggtgctgactgtggtgctgcctgggatactgtccatggtgctgcccatagcacttgaaattgtaacagtttggtcttttctatttaggaacattggccttaaattaaaatgcatttgaaaactacagtcagtgcattactgcagtcagtagtaattatatttttatttatttatttttgagatggaatctcgctctgtcgctgaggctggggtgcagtggcatgatctcagctccctgcaacctcctcctccccagttcaagcaattctgctgcctcagcctactgagtagctgggattagaggcatgtgccaccacatctggctaatttttgtatttttagtagagaaggggttttgccatgttggccaggctggtatcgaactcctgacctcaaatgatccacctacctcagccttccaaaatgctgggattacaggcatgagccaccacgcctggccaatattttaaatatacttattcaaatttctcagtatgaagatgacatgaatatatgtatatacacacatatatatgcattatgacattatgatattgttttggtgtctttaatgcacaaaatggtattatactgtacaaacctttctgcagtagacttttgtcactcaatattatgttttcaagggccatccacctttttttgagatggagttttgctcttgttgcccaggctggagtacagtggtgtgatcttggctcactacaacctctcctcccaggttcaagcaattctcctgcctcagccatctgagtagctgggattacaagcactcacccccacgctggctaatattttctatttttattagagatggggtttcaccatgttgaccaggctggtcttgaactcctgacctctggtgatccacccacctcagcctcccaaagtactgggattacaggtgtgagccaccacgcctggccaggccgtccatctttaataaatatacataaagttggtttttgtttttttgttttttttttgtttttttgacagggtctcacttggctggagtgcagtggtgcagtcgtggctcactgcagcctcagtacctggctaattttttaattttgtgtagagatagggtttcactgtgttgcccagtctggtctctaaatcttggacttaagtgatcttccctccttagcctcccaaagtgctgggattgcaggtgtgagccaccgtgcctggccaagttttaatttcaataaaaattgctgtaaagtattctacattatgaatatactacattttattcattgttctcctactgataaacatttttcaatgtttaagtactataaataatgctgcaatgaacctccctgtagatgtgttgttagacaaatgttctagcatctttctgggacagacatctagaaatggaattgctgaatcatcatattcatttttacattaatatttcaacctataaatgttttcaaactacatgagggaaacaactaagctcttttgcctatcaaagttactcagcatataacctgtactttctaggatttttttttttttttttttttgagacagagtttcactcttgttgcccaggctggagtgcaatggtgcgatcttggctcactgcagcctcgcctcccaggttcaagcgattctcctgcctcagcctcctgagtagctgggattacaggcatgcaccactgcacccggctaattttgtagtttttagtagagacggggtttctccacgtttgtcaggctggtctcgaactcccgacctcaggtgatccgcccaactcagcctcccaaagtgctgggattacaggcatgagccaccgtgcctggccattctaggaaatgttaagaaggagcaagccatccagaattggagacaggagagtattctgaaacttttagccaaaatttgaacttattatttgatcttcagtgagttttatgttccttcctcaggctttgttattttgcttttgaagtagttaaaatatgtatatgtccccctttaaatacagaaatctgattatacaaacaatttcatttaaagagtttacagaaaatcggccgttcgtggtggctcacgcctgtaatcccagcactttgggaggccaaggcaggcagatcacttgaggtcaggagttcgagaccagcctggccaacatagtgaaatcctgtctctactaaaaatacaaaaattcgctgggcatggtggtgtgcgtccgtaatcccagctacttgagaatctgaggcacgagaatcacttgaacccgggaggtggaggttgcggtgagttgagatcgtgccactgcactccagcctgggtgacagagcaagactctgtctcaaatataaaataagagtttacagaaaatccttgtacataactcaagggtctagaatttaagaaataagtttagaacagaatttagagtgtgaaacgaccataaagacttatctagttcagtcttgatttatagatgtgacaaatcaaggcacagacaacttaaattatttacttggattcttctgattgctagcagaatctgttgaaacacacatactcaaagtccctttgaagaaaacagctttgtttgtaaaccactagaatctttgcaacagacatttaatactgcacagtgacttcttttgtttacctcttgctatttgacctcagtaactcacagaaatgccatgcctgttgttcaaagcaagtgtgaaaaaacagtctttgtttataacctgcttttgtggtgagaactgtagaagctcacttacccaatgtgacttggactggtaattaagtgaaaagttggttaaaggctttttcttggaggtgtggtccatggattggagttctgtattatcttttgtgcatacactttacccataatttccaggtggatttctttgaaatggctggagaacttagactttgtagagcatctgagagtgccaaaacctcttggatttttgtagagttcactcccaaccttttctaattttaatgcttatacctagttagcagtattttttttttctagaagaaacacttcatttaaaaaattttcccaaagctttcaacttataatatctattctagaatgtcaaagtcattgtaataacagttcaacaaccaggccttcagaagtttttatactatttaattatatttcataattaactgtaacaagtgtaactagcacagacagataccagaatgaacttggttgacccatgatgtgtagcaactcctgtctacaagctctgagcgttaggcaaaccataggctgatgggtatatgttggagggataaaagttggtcagctttctgatgactcagctcagtggaggttgcttaagagagctgctactgtatccttaaggggccattggtaaattttaggacaagtatcttcagggaacctaaagggaaaataaatgtgtgtgtgtgtgtgtgtgtgtgtgtgtgtgtgtgtgtgtgtgtgtgtgctcgtgtgtgaagccttattgaagagtagcaatagactctttcttactaggcgtaatcaagttgccctcctggggaaactcaaatgcaaaaatcctcttgaacttttctgggtagcctactctactctttcctaatagtaccactacagtatacagcactgtaaaattttttgctttaaaagtttgtttataaactggcatttataagtatactttttgagctgatttaagaatcaagtttttttttctagggaaatgcttctttgtaattatctgtcactagcaaaatttgttttaacatatatttttctaaaaatatgatatgtaaactgtgttgtagttgtacaattaaaggtttttggtcgaacagttattacatgatgtaaaatcatgtgtaacactttaatattaattacattgtaacctaaaattcattttaaaactttttatgtggcttgaacaggaattttcttatccaaagctttgtatgtatgctttattgcctcctttgttattagcatggagaccatgggttttctgttattgttgtttcatttaaacagttcatgaatatattaagcacctgaaagaaactgttagatgctgttaataggaagaggagttaaaaacctcgtccttgcccttatctacatgtgtacatgtagaacttactgtagttccctagatgtagcaggtgctcaggaaacatttttgtagtagtaaaaaagaaatgtcaaactctaacttgctctggagcaaattccgctagtaaacattgtttttcaagcttcttttttttgccttgcgtcctactttcttaggccaaaataattcatccacatcccaccttagctgtttttttgtgtcaaacaaaaatcttatttggaaatagcatgttacgccaactgtgttggggcatcccatactgtattgcattaaatgaggagaaagatgcagaggccatgtggggaggattgtgatcctgataagagtgggatgagggataacaacagagagactgccgttcaatatttctttctttctttttttttgagacggagtctggctctgttgccctaggctggagtgcagtggcgtgatcttggctcactgcaagctccgcctgccaggttcacgccattctcctgcctcagcctcccaagaagctgggactacaggcgcccgccaccacgcccggctaattttttgtatttttagtagagacggggtttcactgtgttagccaggatggtctcaatctcctgacctcgtgatccgcccgcctcggcctcccagcgtgctgggattacaggagtgagccaccgcgcccggcctgccattcagtatttctaattaattcagatggggaagaaaatctctagtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctagtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccacctcggcctcccaaagtgctgggattacaggtgtgagccatcacgcctggccaaatgaggaatttaagatctaaagaaggtaaatggtatgcccatggctacacagctaagggacatagttgagataagaattaattaaacacatatttgatagtacctagtgcctagtaccagtcactgttttagacactgcagatcggcagtgaacaaaatagatatgatccctgctgtcatagaacttactttctagttgaagaaaacagaaaataagacaggaataccatgtacagttaggtctctgatgaaagtagatcaggacaattcaccagagagctattgcggtgctgttgtgtattggatgaccaaaattgtgctcagattgcctagctaaacttgatggtttttacctttgcttttagttttagtatcctaatagaaaatgtttaggagaatgtttaatagaaaatgctttggtatttataataatttaaaactcagtagcatgtagaagtcagtaaatccatgaaagagaatctttcgtaattcagagaagaagtaaatatcttactccagatcactgtccttaactgtttcttctcatttgtggtatctcgtagtagcagaatggacagacagcccaacctgtaatatttaccattataccccagcacatagaagaagaccaaacttttagaagggactcagcaaagatttggtgaatgagtaattgagcattcagaagctgtctctgcacttgtagggcaagcattttgtactagtgatagaaaagcaggaattgtagagtcacagacccagggttgacttctggcgctctcatttactgtgactttgagccttgttgcatagcctgtttctgcatctcagcttcctcactagtaaaatggagtcgtagtttctgcttccaagagtgtttgtgaatattatataactggctgtagtgtttgaataaaatactaagaaactttattctttgttagaaatagtaaatgtggtactcttgaattactttaggtggcactctgacatttaaattagatattttttatccatgtggaagaaattttaaacatgagttttgcagtcattttgtaaacactgatcgtaagtgctaattcccttttcttcattggctgtgagtagtttgtttgaggagcagattggagaggagtatataagataaactggttttctgcatttgaaaaacattggtgatgatctgaggatcaaactattatattatgaagtgatttttctccccttacctcttttctacatagcttgtctttagcttcaatgaaaagctttttggcttactggtgaaggacattgaagccatggatcctagcatcctgaagggagagcctgcgacagggaaaaggcagaaggtagcttttatttctgatcatctttactagatcatctttataatgtaatttgtgcagattgattataattttcctatctgttgcttagtgatttttttcatattgtgtacccttttaagatagtagggagaaaaaattgctttcatagccatcattgttattaaaatatagcttaaaatgtatttatttgcagacctaatattaatgtaaaatgtagacatatatgtacatataatttgcttgaatgcagatatttattgtaaataaataataagaaacgcattattggaaagatataggcatggaaataaggcatgtaagaattgtagaagaaagttatgagaaaagtaaaagtagctcagatgatagtctggaaggtttgctttgcccagagagacctcatttccccctcacttttggccttgctttgagaagtccagaagtttgctattagactactaattattgtctttctctacagattgaagtaggactggttgttggaaacagtcaagttgcatttgaaaaagcagaaaattcgtcacttaatcttattggtaagatttacagtttttagaagatttgaaatgaagtgggcctatttctatatgtaactcaactacagtgatttccaaatggggaaaggaaagaggggcatctctcttgagagagtttatcacagaagcatggggtatttcctgttggtcagtttgctgatgaaaacgtttaaaaccttcatctggatcaactttgtccaatagaaatagagtgtgagccacatgtgtaatttttaatttcctagaaattgcactaaaataagaaacaaattaattttttaacttttaattttgagataattttaggttcacagatttgcagaaatagctcagagaatttctgtatgccctttaccagcttaccctgatgttaatgtcttatttgacattttcaaaagtacaatgataagaaatgaacatggtttcatttctgctaactaaactacagattttattgagatttcaccagtttttccattgtgtccttttctgttccaagatctaatttaggatcccatattgcatttagttgttctgtcttttgagttttcttcagtcactgacagttcctcagactttgtcttttatgactttgagaactggtcagttattttgtagaatgcccctcacttggttttgtgttaaatgagatagcatcatcatttcttttagtgattaagtgatgaatgtgcaggtcaagtcttcccagcagattcatggttcagtcctactcttgtactctagcacaatttttgtcatattaaaacaattgcagcttattctctgagaatagtaactcaccagaataatgtgacattaactgggcattaattcttatttttggttgatttaactatgttgatgtctaccctactagagagtagagggttttcattggttgcacatcatcatgtccagggtcacttaacagtctttgagtgcgtggcctttatttcctggtccacaaattaccattcccccttattgttttttgttaattataaaatattttatttataaaatatggataggcattcgaaaacaattcacacactgtaaaatttggttctgttttcatagttttgtaatttgctttttttgcttagcatgtttcaaacatcttaaatatacacctataacatgatttttaatgcctgtatgtcattttatgaaggtaggatgtattttcctgttattgatctagtacatttatgaagtgatttctttgtattttatttttgtgtaccttttgttaagatatcccaagggagttgcataactttcataggtatttctaagtaatccatgggaaaaaaattgtgtagttaattggcattcagtaaattttgcccacaagagggcagtagagtgtaagaaaaaaatatttttcatcgctttccaaaggaaatcttaaggcctcaaaactctaaccataaaattatcatctagtataaacttttaaaaagcgttactttatttttaattgacagataataattgtatatatttatagggtacaatttgatattttaatacatgtatacattgtagaatgatcaaatcaggctaattaacatatcacctcaaatatttagcatttcttaggataaactttttttaatgtgacattttcttccctggttttataaaaaccatattattactttattttttgtttataatagagcatactaaggtacttaatttattctttgtttgaaatagtaaatgtggttctcttgagttgctttaggtggcactctgacatttaagttagataatttttgtcctcttgagaatttttaaacatgagttttgtaatcattgaagtctttaggatgatttcagacttttgtgtccaagtgaagagaaagcaaagaagacatcaaacttgttcagtatatttccttaggctgaggggttatatgcccaattacctgtataagcttaatctggataaatatatgtattttaaaataaacttgcgttaggagacttcagtgactgcgagatttcagttgcatttctgccagctagtgttgtcttcatcagatatggcatttcttctgatcaaccgagttagttaatttagttagattgaaggttaataaaactaagttttatggactgatacaaatagactacagcataagtttagctagtcattttgacagtgtgttaccatatatggagatcagacaaagtagatagcatagcaaaacttacccttctgactgtaaaatcagctaagattatattgttcgttttgtatatgtaagggtagcttttctttattcatttaggatgctcagggagttctgtctgtctttttagacttagtgataaagtccttgtttcacatttgataatattcgtttgacataggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggtaagtttaaaaaggaaaatgttataaaatcttgtgttgttaaaaaaattaatgcaatgaagaatctcttttcaatagttttgaaattatttttcagacccattatttttgtctttttctttaaaaatgaacagataaattttctgaaaaactttataataccagaacttttaaaattacattttaattttatggggaaatcatagaaataagacttgtggtggctccattttgtttatttatttattgaagaatgcttttctatggggcatatttagaaacttcccctgacagtaataatactagtagtgactccattttatttatttatttgcgtaagaatgtttttctatagggcatatttagaaagttcacctgactctaaagatcactatgggtcagatgtaccctgctgaataataactatctattaggctgtgtgcattgttctgacattagctgccgttcctttttattgtactgttgcattacccagttagtacatcttcatacctaataaatgggtacttgcatatttttaaattaaataagtttgatccaaaaagacaaatgcaggatatacattggagtttctatattgcatacaaagaagtgcactattcgtttaccactttcttcttgaaggtttatttaatttatctgtgtgaagtgactttatttgcccagtggaaatgctgtcatgactgttttcatgtccatatcattcgttggattggaatgtgagcaacagaatatctgagaaaggaatgtataacataacagcttctggcagactattagtgtaaaaacagcatccaaaaaaaatggaaggaatatgaatatattactccgctcatccccatcattctttatctttaaattgctactggaagataaaagtatatttattatagtggggataagaactgctttctaggcactaagtgcttggattgtattagccttctattgttggtagcctttctgcctggtcgctcactctgataaattacaggcacggcacacacctgttcactgagtaaaggtcgagtttggaattggattaagagaaaatgacagagaccctcatcacctgagttttatacaccttgaaatggcaatagcatactttttatctcaaagatacaaaggccacgtccattaaaagcagaattttaattgggaaaatattttaaaatgtggtagttcactatcttggtaatgtgtattttcgatcaagacatgaaaatattgtttaagtgtattttgggtaaaagcagggataaaaagatgattccaaatgttgtaagttattcttgtggaatgtttttactggttttcagaactgagatctagtgcaggaagagtctaatgattctgtttcttagaacatttatactgtttagccaaaaagtagaaaaataactgcattggtagtaagccgtctcttttaattataaatgttttctcactgtttggaagctattgaagataacagttattcagatactagtttgctatttgtgcattatctagatcctgcacttgaagctacgcgcaacgtcagtatgcgttgggtagataatgcgtaaaggagttggtctcacattggtcagtttgtgaccttgccagctgttggagagttttaaattaaatcagaacagatttggaatttgttagtgaatttcatctgtttctgatatccgtattgaaatgagctgaattacagtagtgtgctttttgttgtttttgatgtgttttttgactaagcactatggatttgaattttgtgagtgccactgtccagaaccttttttatggatttatttttctaatatttttacactaatttaattagacaaaaaatgaattctatccttttggaaaagttttttttttttttctctttatggctttttgccatcaggaagcatttgttaccaatttcattgaaaagacaaactagtataaagctgtcctggcttttgagctgaattgaaaaacttattttctttattctggatgaagtttctgggtatctaaaaaaaagtaaagcttcttcttttttttttttttaatggttaaatggctgagaaataattcttttgtaatgcatgtataattccctgtcttccaatagaggcttcttttttcctttgaattttgggggaattatatagtaaaatcctttcttgcactccaattacagtgtggttataaagttctccttaggctttggtaaaggtatataaataaaaatggttatattttgacagaatataaataaaattatacaaattatttttatgcatattctgtgttgttttttttttttgacatgtcaggtgggaacaacatggatttttttcccccactctttgttaactaaatagacagatctatatggtttggggattcagctggacactgagtatgactggttaaatcagttctaatttttaaaaaagattagaaaagaataatttatgtaggttatggggcttttttgttttaagcagaaaactttacttttggcttgagaccaaattactgtctttaccatggagtctaaagtgatgtctacttcgtaaacaggaatcttaactaagtggattttttgcctatatatcaattttcaaatttacaaagtgataaatttagaatattcttctcttctgtcattatgttcatcagactgataattatgcttctaggtaacagagttctttctttttgtctataaaacttcatgttgccttttcaaaattgaaaaatatagtttagctacgaacagaatgttgctgatgagatataggaggactaaaggacttaacgagaggcacacaattaagcagtaaaattagggaaccaatgaggtaatatacttgaaaataactgtcatggagtttccaatctgttagtttctctcttgaaggtctttcaaataggtagtgtataccttaggccgggtgcggtggctcactcctgtaatcccagcacttagggaagccgaggtgggcggatcatgaggtcaggagatcgagaccatcctggctaacacggtgaaaccctgtctctactaaaaacagaaaaaattagccgggcgtggtcgcgggcgcttgtagtcccggctcctcgggaggctgaggcaggaggatgtgtgaacccgggaggcggagcttgcagtgagccgagatcgcaccactgcactccagcctgggcgacagagcgagactccatctcaaaaaaaaaaaaaaaaaaaaaaaaaaaaaaaagaagaagataatgtatgcctttctgcttttgtacttttgttatatttttgtagaattaaaatcaaggaaacccttaaaggagaaaggaagtcacataaagctctctagactgagggataaaggaaaagggattatttaggggaatatcaatttagacttttgtttttgttattgttttaatcagagtaactgttgagttttccccttgtctgaagcagttgagctcacccaaacccaagtggggcagcccttccttggaaggatatgagagcaacgagcgaagaaaactaaacctataccttgcacttagtaaataccaaatagatatttagttagaatgccttccaaccccccacaaaacagatttttaattaagaattaccttaaatccataattttatgggctaatagaagccacatttgagtcccagggtagaaatgtgaacatcaaagctggtatctggaagtatgggtgaataaattcaacagctgattgctgtctttcagcatattcaggtgttaactgaatagatactgaatacttgtgttcggacatttaccacacttattcccctgtatgcagttttgtggacagtgttcaggataaataaatgattgattacctcagttctcactgtagctattttgttagcaaagatagcgtttctgccaagaaacttcattttttcagcatccctggcaattctctctaaattataaatgtcaaagcaaaaaaacacatcgttttcaatgaacagtggaataattgttaaagaattagtcagcatctcttaatgtaatcctgggaataggttcacatctacccaaggaaagacctagaaggaaaaggatgtaaagagggaagacctcagcctcacactgtctttcagtggatctgtggggtgtagatgttcaggccacctagtggggaggaaagccacttgttatggtcttgtgcccccattctttgaaactgacactgtgttctttttggtctcctttccccagtgtctccctctgtaagcccattttcaatcgtatttttaaggtttcttttgaaattcaagaggaaagcaactcttttctgatatcataagtgaaattgtagttactctatgaaacagaactgctgagaagataaggaacctttcaatcacacagacatctttcacatactaaaaacagtgcaaataaaacatagtggaagaaagggcactaaggttttgtgcatgccatattttggagagagggagttcttgctaagattaacataaacactgacactcttaaaatgcattttcacacccccactcatgaggagagattgcattttaaatgggggttaagacatccaggcgaactccagggctctgtaaaaggaaccctaaggctaaagagcttatctgaaatttgaaaaaaagaaaaaaaaatgaagccttctgacattcatctttttttcttgtattagtcataacttgcttttcagctatattttaggttttgaatgccaacctgacatctgttcaagtctgcctgtaatttattagcagaggaaaagacagcagttgctcactagttagagatgcaaaatttctgccttcctgttctccactaagtacttatagatgatacctggatacgaagaatgtaataatttactgaaaacttcaggtcaggaaatttataaagatttttttttaattagaagaataaaatggcttaagaccatgtgatttcaaaaatctctagatcaggatttagagacaaaacatagaccctaaaaaatactttagataactttctataaattgtaatttttttaaccttgaattaatttttccattggttttaaatttttaagttaaatgtatatttgaacagcagttgtgcttatatctgaaagtcaaactgtatgtaaattcacctggcattttgcatttatagacagactttaagaaacaaatcttttggagaggtagtgctgtctacagagtcaccaaatggattagatttcctggcaactacagttgagttacttacagatcaacagttgggtcactacaaagttgagatctaagtgttaacctgagtgcccaccagtaagaaaccggttagaggcaatcttaaaatgatatagctccaaatgtagagacatgtttgtgttaataaaaaatatataaaagcaaatgcattctaaaaatctctaaggacatacattaaattgaaaaaaggtttatggctgaatgtggtggctcacacctgtaatcctagcactttgggaggctgagatgggaggatcacttgagctcaggagttcaagaccagtctgggcagcatagtgagaccttgtctcatttatttatttttttaatttaaaaatttaatttaaaaattaaaaaaagtgtttacttccatggaagggaagctaagatggggaataaagggaaagttttgttcttttactcaattttacctttatgtctgaatgttttattgtatttctaatgtgtgattttaaaagccaacagacaaaagataatatcacagtatgtttcttggggtgactctaccatcagcatggaaagtcagcaggaaacaggtacatccttccgccttcatgaagttttctgtggaggaggagagtgcagggtaaaaggcctggattccaagggctttgctggcagccccttagagggtagacagaacacctatcctatttggtcaagaagagaaaaagtttctccatatataacaaactgctttcccccagaatgttctgcattatagtaatggtgtaagtagtctgcccttcaaacatgagaacatttgcatccaggcctttaggcagccaaggcagcattaaagaagaaagagtgggagcagagcaagctgagggagagcagagcttctgacatttgaggaactgggcgtgaatttgtttttagtcttcaaaaaccattctcttgaggaatcgaattcccatgactcctgaagtgaagcggttggtgttttctcctgcgttactcccatacgtaagttggtgattataatgagggtggtggctaatacttatataatgccagacgctgttctgtgtgctttattattgtgtttattaatcctcacaacaaccttcagaagtagacactgtattgtctccatattatggagcaggaatctctgtctcaaaaaggtgaagtaatgggtccaagacacacagctagtaagtagtagagtcagatttgaacccaggcagtcgagccccagatttcatttccttaaccattacatgttattctcccatgaaagcccatcgtgtaaaaccattttaatgggctttctagcttcacttttttggggacctttgaagcaatcattgaggcagcctttgttctagccaagggccaaccatggcaccattgagattttgagctgtataattatttggtctggggactgggtgtcctttgcattgtaaataactaacttttctagtaatctgatgtgttcaaattgtcatgagctcaagagacatgaagatttggtggtaggctgtaatacctaatgccacttttttcatgtgttttttgtcacgtgttgtagcagaatacaggaaggaaggaactggaatgggtgtgtcagagaagctgtcttaaactgtcaacctggagagggaacataaatgttaaaattaaataatcattaaaaaattaagcaacgtaacaagtgatatcaaaggccagtatttgattaagtgccagatgagcagtacaattgataagccctacaggaactgaaagggaatcacatcgagaagacttcatagaagaggcagagcttgagtaaggccttaaatgctgagcggttttggataggaggagggaaggggatagttgtccatatcctgggaagagtgacagactaaacacggtatagacttcatgacttagaccagtctaacagagctgttgtttggaagaaacaggaaataggattaaaaagttagttttgggttgggttgtggaaatctgtgaggagatgtggactctttttaaagtactgtccctgtttaagcttccagacagactcagaaccttccagacagactcaggtgcttctcctgtgtttccctgcaccttgtatatacttagaatccagctgtgttcttaatgtaattattcatttgcattacactcctaaggcagaatttcttaaccttggcactattgacattttaggctggataattcttagttgtagggcgcctgacctgtgcatcataggatgttaagcgccatccctggcctctacttgatgtcagtacttcccttcctcaccactccgagccccagtgacgattaaaagaaatgtgatgaaactgtcctgtgttgagaaccattgctcaaaggcctttgaaggcacaactgtaatgtcttcttatccatgtattatcaacatcaggggtgttgggatgtaggttgcaggtcattgttggaccatgaaccactgttaccagtccacaataagacaaatattggaaattaagaataagtaattacaaatgtttatagcaatttgacattatcacaatttttttaaaattatattttacaaaaatgttggtctgcaatggattggaaatttaaaaggaaaaaaaatacagctggaccttagcatacatagtttgagaagcactggcctatgtaaatatttgcaaaatgaatgaaattttttgaacagatgccttagagaaaaggtgaggcgaatagtcttagagaccagtagactattgctgtccagtgtgtggtacttagaatctggattggggtgaaggcaacaggaatggaatgggaagaaaatacatgaaaaaattgcagacatgaaactggcagaatttggcaatagttattgtgggtgacagaattggaggtgagactcaggtcttgtgagaaaatgttggaaatgagaaactcaggagaacatagttttggaaaagtagagaatatcattgcacatattttcaatatcgtgaaaggaaactggaagctgaactgaagagaggaagaattactggcatttcaatttattgaagcctagcttcaatcagtctgcacgtgtttaggaaacacactgttgactacttttgcttgaaataccctctttacttggcttttctcactccaagcatttctggttttccttttacctctctggctgtctcttttcaacctcttttgtgtcccttaaaatgttggggttcctcaggagtctgtctttgacctattatttttctctaattattctcctccaaattaatcacatctgtttcatagcttcaattagtatctttatgctgctaactctcaaatatgcatatgccacctcggtctcagtttagaactctggatttgtaccagcataatgtgttgggtatttcatgatcacatagtaagcttgaaattaaacacattcagttgccccctcagtcctctctaaacatgcatctatatctgtgttttctatctctggcaatactctagccaaaaatctggacacctttaactcctctctttccctcacctcccacttccagtaagtcgcagaatagaccgtcaattctgcaatctccgcaatctctctgaaatccctccagttctctctacctcgccctgccactcttccttcaggacaccattatctcttgcctgaattgctccataagccctcagccttgcccttctctaatccattctccacactgtaactggagtgatttttataaaaaggcaagtctgatcctgtcactgcactggttcaaactctttagcagcccgccttaactccttacatggtttacaagccctgtgtgatctggctcctgctaaactttcttgcttcgcctctcagcccgtgcccctcccccatactctgggttccagccagcctgtgctattttcagttcctctaatttgccatgctactttctcttacctctatatcctagggttatttttttttgctttttttttttcttaaccatcttttcatccaattcctgttcactcttcaggccaaagctttgaactcactgtttctagaatgagtaggctttaatgttcctcatgtgtgttctaatagctccatgttattttatgcattattacattgtattataattgcttattacatgtctgtattccaagtcctctctccatgtccctgccctcacaaacatagtataccttcagtaaggaataggccttgtttattttggtcactgtcgtattctctcctcccggcatggtgtctggcttataagttttcaggaaataaataaatgccaggaacttgattaatcttgattaattaaatagaacacttagacagtttgatccaagccctgccctcatgatacttacagtctgtgtgggagtaacactgtatttgcacatcccaaagcagtactgtgtaaaacataaggtgcattgtgaaccagattagcaaagtaggccacatggagaagcagcagatgcatttaaagagcaagactgagccatatctttaaaagtcaaagcagatatgatgtttataattcattactaaatccatgtagatcctcttagattctgaatttaggaaagacctcttggattggtcctgaatggcactaggctccagaaataagaaaaggaagagtattttcttgggtacttgtgagctaccatttgcttcattgggaactgccattcttatgtaagggcactataacaagagtgttcacatttaagggcatcaggtcaatattgcgtctgtgtgagtttgtgtgcatgtgaatgcacacatgtattttctatttttaaatagaaacacattataaaaataatgcatcctcataaaacagcacagatagagtaaaaagtgaaatctcccttcattctacccactccagttttactccctctcttagaggtagacactgtaaagagattggtatgaatttttcaaaccctttcctaagtatttatacaataatatataatcaatccattcattcatttattgagacagggtcttgctctgttgcccaggctggagtgcagtggtgcaatcatactccattgcagcctcgcactcctgggctcaagtagtcctcccacctccacctgccaagtagctgggactacacccagctaatttgtgtgtgtgtgtgtgtgtgtgtgtgtgtgtgtgtgtgtgtgtgtgtgtgtgtttgtgtagaattggagtctcactatgttgctcaggctggtctcagactcctggcctcaagcagtcctcccgcctcagcctcccaaaatgctgggataacaggcatcagccactgtgcctgacttttttttttttttcaacctagtagtgtatcttgggtttttttctgtgataaagcacacagataacattttattttttaaaaagttaaatagtattagcagatctgcatccacacaagtcccgtcatggtaagttagcgtctcttcctcagcagtaagaaggctcctaggcacacaccagaacaaggttggcattgcgtctcctttctactcacttgtatggccctaggcttctcaatgcggcagggccctgggcgctcagctacttgagccttggtacccttgcctgaaaaattgtttattggtaggtaacattaatgtgtgtaagttttctaacacagtacctggctgactgtcaaacactccatggatgatagttacttggtatgattatattgccaagaggcacttttggagctctgtaaaaggcaaaaatttataacccaatccctttaatctaatgttaagatgtgttttcttcttatcttaaattttgttgctgttgaaaatagttaacacctgagattttcctcctatgctgttttataattacccattttgaacagtgtttgttgataaggtagtcaaggggacacttcgaaatattttttctttatttgtgaagtcatactttggctgatttatatttaatttttatcacattacatcggagaggagcagataaattttctatcacctctataaattttctatcacatataagaaagtgtatcttatatgtgatacactaacttggaaaaacaacagctatcttgatagacacaatagagaataggatgtcagaggaagagaagaattagaatgttaacaataatgctagtaaaaagctacccaggacttaaatggtattatttgagagtacttctaccatgattcaaataagacttgccttggaattccatatgatttgttacttagagcagtctacctttaatatgtttaatatggtcatactttaaaaaaaaaaacctgcaagaaacttgggtttcacgtttttgctttttaaagaattaacataatgttatttcaggtttgtaaaggaagttacagaagatagcaataaatcccttccatataccattttagtcatagtgcaaaattaggcattgaaaattattatgggtactgtattagatattcaaagatttatttgtggctttgacttctttaccaacacctctggctttaatacagtatcttttatcagagcaagtaatagtttgaatccttttcttacaaatcctctttttactcaagtgactgcaaacttataaagatgcacacatctgtagcttgaacgtctatgctatttgctcaagtatttacttgaatttatcctcgatgatatgatttttttaagtgctttgattttaaattctatctagaatcccatcatgagggagaaatcttagcaagacttaagcaccttttcataatgactggttactgtaggataaacctataattagtatattgctaatccacacgttagatatatcccatcaaatttcaaatatacacaggagaattatccacattgaaggttattagtgcattccagggacatttccatgttgattcacaactacccctttaccttacactttcctgtgttactagacgtctctttctgtaaaacttctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaacccttttttttcatgttatctagaaatgaatctttaaaaaaaaaaaaaaggaatgggttgaacttataatattttagcaactcataaaataacttgaagaaaaagatcatttggaaggagagacaaaacagactgaaagacattgtttaaatttatgacttttattatcttacttgaatgctatttttgcccctctcgctattattaaaccctttgcttcctgttttcagttgctcctgtcaaggtatgaatttttctttggatgattgtcatctatttcatattatctagtattcctctctattatgagaaaatcaaaagtagacagtgtatctatagctatagatttaaatgcactaaggtaattatatatttgaatcagagacctaaggaataatctagtgtagcatttaccaaatttatttaaacttaacatgcttacatgaagacagacctatttatgtttccaaggaacaccagtttgagaaatgctgatcttacctgtgtcattcttattttgtagatgaggacattgggacctcagaagaataaggcaacttatttaggctaaagtcactgcttgtctactggggctggaatccaggttgcttagtctggtgccctttaggcttcatgattcagccacttaagacaatttgatttattgttgggctttttaattctagatttcataacttggatatgaaactgtacttcccagtctccaaaataagcttcactgttttctggaacgtgaattagattcagaaagccccttactgcctttagattattgcagcctccccagtgggccccagggatccaggaaaaatatctttgtttttcacctagtcctctcctcagcttttagagggactcttagatctatgtttatgaaaagacttttattagttcttatagttgtagtaatgcatgtttattgtagaaaatttcaaaaatgtagatgaataagaagaataaaacaatcactcagtgtaaaaaacaaaaaaccctgaaaaagtaccattaatattctggagtatatcatccagctagttttagctgtatatacatagagccaaaaaaaaaaaaaaaaagcattttgctgttttataactggttttctccccactcagtaagttaacagtttttcttaaatattctctacaacattctttattttgtagaatgataatgctgtggtttgtttaatcaatcccctctagttagaaattgtattcagttttttactattatacactatgtttaacaagcaccttagaaactaaatatttctacacattcatatttctttaagataaattcctggaagtagaattgctgaatcaaaaaggattcacaagtgtaaatgtttttgacatgcactgccaaatttagacttcctttttgaaaagtcaaatgttaaggagatcaaagcaatcactaagcaggtactctggaagagaaatagaaatataaaaaatataatggtttcatgagaaactaatagacaaggtttcaagagacttggagtctagttttggatttgtcattgaatggctgtgacttttgggtcttagtttcctcattataaaaatgggaagatagactagaaatagaaactttttcagaatagtcaccttatgaatgttgtttcagtgaaatataaaggtctgtacataagttctgcagggaagatgccatgtatttgctcattcttcaagtttcagcttgattgcctttggaaggtctgtcacacttaacgtcctcctaatagaagtaattgttttactttttggctcctcatagccctttttaaatgttggttctgtatagttgtatctttgatttttaatattgaggtatttgtaacagaggttatcttactcatctcctgaaagcacttggcttagcatagttcttgggtatataatagagactcagtaagtatctgtggaagttgagagtgataccttgttccccagtgtataacagcaaagcctagcctcctcctgttgagcattgtctgttctcgctttgaagagctcaccacatttcttcagtttgtttttgtttttattttattttattttattttttttttttttggcggggtggggtctttcctattcagtaacacagtggttctcagtctttggtgtgtatcagaatttttttttttttttagagttttgctctgttacccaggctggagtgcagtcgtgtgatctcagctcactgcaacctctgcctcccaggttcaagcgattcttgtgcctcagcctcccgagtagttgggattacaggcacatgccaccatgcctggctaatttttgtatttttagtagagacagggtttcatcatgttagccaggctgcccttgaactcctgaccttaagcgatccacccaccttttctggtattacaggtgtgagccaccctgcctggcccagaatttttaatgttaaaaaaaatacagatttccaggctctcaagtacactgaatgtgagtgtcaggcacaaagccgagacacagcgctgtcaatagctgagctctccttggggttttagctttgtcaggcaaattgatattcaagttccaggtctgccacttaccagatgtgtcttccccttaccaggggaaggtcactttaccactgtaagcctcagtacctcttccttaaaaagagggtaaaaataataccttagctcatagttttaaaaatgattacgtaagagaacatattaaaacacgtagtatagcccttcccatatctgcagttctggccttgatctgtaacttcttggatcttatatgcatttattatttatttgtttctttttaaaataacatttatattttttcaacttttagaggttaatatgttcattatagaaaactgaaaaacacaagaggcatataactaaaaaatcatccataacagaatcagtttacattctgatgtatctttccagtccttgtatgtgtatacatatatacataactgagtatacctttttacatggttacacttatatagtatgtgccatgctttcttgcatatcatgagtacttgagtatcaaaatactcagggctttaggattcagacattggtaaatattcacgatacattttcttatcttttgtggggacaaaaatatcttaaaaaacaaaatggcaacaggtctctggaaatgcatattggcaggtttatagttaaatactgtgttcacttaatacccaatataaaatgagatacaaagcagtcaagtaagtataatgcttcttagatagttcagtatgagatctgcactattaaaatattaccagaaatgatgtttctacttaattatttaacaattcatatagtattcacaaagtataccaaaaaaaaagcacacatatgtcagtggttataatcagattgtaaatatggacatatctatatatatctcttcccttacctttctttctgccccttccttagcaatccagtacgtactgatgtatactgctcataggtggtttaacattgccatttccaagatgcttcttttctaatgaaattaatttactatctagttaattcactagctctattttatacattgtcacctcataacatctagaaagcttagtgttgtgaagtaaggactgataaacagaggcactttactaaaaaatcacttcctagaactgtggctacaatatgaaactatcttctagatatgaacatacttgcaaagaaccttccttttgcctttcttcttccttcttcagctcaatgaataagtacagaaatgcatatagctctacgagatgggttaacaacagtcactcccagacaacaagccttgctaaaaactctaacaagaggacatttatcaaagaatcattttacttcttaaactttcagcatactttgggcacttctcagcattggggccttgtttgtcctttgcatactcaacaatgctaagtaaatgcacttgcagaacgacgagtagataatctgcatttatctcaaaacacactggcacagaactcttccaccgtcacttcctgtctctcccacctcctttactacccaatgagcaaagaatatgtagctcaaagagataaaagtttaacagttccattctaaagacagtcattcctgttaattgacataaacttacttaaagtgtgttattttgtgaagactacatgtttcaaacgtctactgtataatgatagcattgattaaattgtgtgcatataacaaaggctataatctgaaagtatcttcgaaatatgaatattatagccaagtacacttcaccttctcacttccttcttatcattatcagcccaaaggacaatatcagcgttccagaagttgttttcagaagatagtcttacctatgaagttttcgggcatacaagaaaagtatataatatgttttagttcatcatctcttcttttgtcaaacattagcaacctctttatcatctagacaacaagatgtaaaattaggacttgcttgttcattgtacagataaccctcaatgggttatgtctcagcaaacccatcgtaagttgaaaatatcctaagttgagagtgcatttttgacttacagtattttcagttgactatgggtttatcttgtcgtaactgattgtaaatcgaagagcattaccaaatgcatattgcttttataccatcataaagtaaaaaaaattgttaaaagtcaaaccagtttaagtcggggaccatgtgtatacactatgtgcacagcaaagtaaaataaaatgcacagaacatgcaggtaatcttgcctaactacaaacacatggtatagaaccctttattccttcctacacttcctttgccttcctcctccctcagtccacaagcacagatctgtaccactcaaagaggaggtctaataatcccatttccgaaagacagtatttcattaaatttattaattccttttatccaggcatttagtggtcatttttagatgacctttaccacatatcttcagatgctttcaccgtccgccataagaatttttactgaaatgaattcttgaaatgtttaaaactttgttacattctttctcgttccacaagtagttatcccttcccagttacctttcttttttaggtctgtggagtcatgatacatctatccccttttcctttgtttttcatgcatttgtcaaatttattattgaatactcctaaattttttctgcctttatcatttgttttttctttttcattgctttagtcagttacccttgcactacagcagtagcctctttattatcttccttgcctttagtcttcttcctttccatcctggaatatttatttcagagcttactgtacaaaaataccagattctatcagagaacattaaaggaatcacagaatctcagtattgcaaaggatcttagccatctagtgcacacacctgttttttatttgaatctcttctacatttctttttattattattattattattattattattatttttgagatggagtctcactctaatgcccaggctggagtgcagtggtatgatcttggctcaccgcaacctctgcccccctggttcaagagattctcctgcctcagcctcccaagtagctaggattacaggcgtgcaccaccatgcctagctaattttttgtttgtttgattgtttgtttgtttgttttgagatggagtctggctctgtcgcccaggccggagtgcagtggcatgatctcggctcactgcaagctccgcctcccgggttcacgccattctcctgcttcagcctccctagtagctgggactacaggcgcccgccactatgcctggctaattttttgtatttttagtagagacggggtttcactgtattagccaggatggttttgatctcctgaccttgtgatccgcccgccttggcctcccaaagtgttgggattacaggcatgagccaccgtgcctggccttttgtatttttagtagagatgaggtttcaccatgttgcccaggctggtctcgaactcctgaggtcaggtgatccacccgcctcggcctcccaaagtgttgggattacaggcgtgagccaccgtgcctagccttttgtatttttagtagagacgaggtttcaccacgttgcccaggctggtctcgaactcctgacgtcaggcgatgcacccgcttcggcctcccaaagtgctgggattactcatgcctggccctcttctgcatttctgctgagtaacttctgccaggttccttaggctaagcttaagttcctccagtgacaggaatctcactccctcctaaggctacattcctcttttggacaactataggtttaagtttagtcttccttatgttaaggtaagatgtatttgcttgtatcttctcctacaagctctggttcttcccctgaaactacacagaacaagcatgatactacttctttatgaacactctttaggtatgaagaaagctattgtccagacttccctgcagattcctcttttctctaagctaattctcctaagcttggttggttttttctagccagtctttttagccctttaccatcctattcacgtttctgtgaactttaacatttatgtatattaatgttaagctgtgaaacctagaatttagtggagtaatgcaaatgtggtctctgttgtaaaatagatcagaactatttattctttatttaaaacactagtcctttaatgtaggccgaaattgtgctaacatttttgacatcgacattctatcttaatgcttatctaatttactaatgaatgaaattcccagtcatctctcacaaaactgtatctcccccagctgtactcaagtacagaaaacatctattcttgataacttttatcttgttagaatagctcttttctcttctatagctacaacttgtcagtgtgtccttatcagcttatgatttaattgaggctatagaacatatacacttaaaaaaaataagctaagaactcttagaataaaacaacataatgtattgtcagttgtaaccatgaatgatgtttttcaaagtgtgtcctctggcctacattagagttacttagggcgcttgttaaatattcagtttcactccagacttaatgaattcagatttctaggagtgatgtctggaaatctgcattttaacaagctccattggacattggtgcatattaaaggttgacagctgctactctaagtactgaaggattgagcccaaagatatgatcagaattaggtggcattaataaaggaggtgatttctggggacagaagaacatgaactgttagagtaggtagaaattccaggtgtagtaaagaagaaataaattgtctgctagggaagatatttgctaggctgaattaggggcccaatagaacagcacataaaaggagttaaaagctaagggacggaaggaaaaaaaacaaagaaagaaaaaactataaaattctgaaaccagtaaagatacatgctgccatttggcagcaaggcagacctgctatagaagaagcatgatctttgtcatcaagaattcatgaaataccaggcaacaccctatgagggaatgtaaaagggtgggggtgtcagcaaagattagtttggagcattgctacacacatctcatctttagttctaggctatctaatgagaaaatctatattaaatctaagttgactgatttggatatagaccagtcggatggtagacagcttgcacagctgcttggtgctcaggaaataggctgttttcactagcatagcaaaactcagagtgctcttggcattttgaagttggtgggacaacagcaagtctctaccagacagaatagtgccacgaaaatggatggtcaaagtcccgactgcccagatggtatcaggagtagtggtcttggtcttaagtatttccatttcttaaagatttcataagtgcacagataaacaagtgtagatgacaacctattttagatgttgattgagagtcttaaggccaggcgtggtggctcacacctgtaatcccagcactttggaggtcgaggaggctgatcacttgagcccaggagtttgagaccagcctgggcaacatggtgaaaccccatctctacaaaagaatacaaaatcagccaggcatggtggcatgcacctgtgatcccagctactcgggaggctgaggcggcaggatggcttgagcctgggaaatggagattgcagtgagctgagatagtgccactgccctccaaagcctgggcaacagagtgagaccctgtctcaaaaaaaaaaaaggtttttgaaacaaaaggccctcctatataatgagtcaatgaaagttatgctcttagagtaaataattatattgtactactgaaatggtaagtcaagtagaactaagaaaatactcatgactctagttccaatttacaattttcaacagaaccataagagaagttgtaattatggaaacttaaatgatcaaatattaatttgtgtccaggcgcagtggttcacacctgtaatcccagcactttgggaggctgaaatgggtggatcacctaaggtcaggagttcaagactagcctggccaacatggtgaaaccccatctctactaaaaatacaaaaattagctgggcatggtggcacctgtaatcccagctactcaggaggctgaggcaggagaattgctagaacctgggagacggaggttgcagtgagccgagattgtgccactgcactccagcctgagcaagactctgtctgaaaaaaatataataataataattatgattatatttaaaagatcaaatattaatttgtgattatattttctacaagggcatgcactatttaaaattgagcactcaaatctggtttgcacaactgcacagagaagcttgcaagactgccgaatatgtcctgacttgctactagtcttttgatagcctccttctttggcaaacatggctagtctgcatttgtactggaagccacttgggattcctctttaaacatcagtcattgttcaaaacccacttcgcacttctttctctctttatagatcatgttgcccccaaaatgaactgaacactcttatcttaatgctaatttgacagagaccacttctaatttattatcatcctgcttactcttatataaaattagtgtttgctatagttttttctccctttgaatacctcaaagttgactgacagtttttcctcaacgcagcttccctctgataacatccagaaaaaatgaagaaaatatactgctttgtaaaatagaagagcttaacaagtacaaatttgtcacttttttcgggtgtttcgaaagagtgtaaacagtaaacattgctgtttatttcttgtgtttcagaagtaaggctatgtatttttatcgagctatttacaatttacatataagatgtaagtattttcatgaatcattttcatcagtggggtggatatacctatcatagtggatacggtcctattctgacttttagatcagaaatcactttcagttatttgtagcacacaccttaaagcctattaaagttctccccaccaaaatttgtattattataatcactggatgtcaacacctgtggctcaaacagtatccaaattttgtatattgttggaggattgctgatttaactgagagttgtagctagaaataaggtgagaaagaatatacaggtaatactaatccacctcaaactaagaagcaaaggatggtggatgggctatgttgatctagcgttgcaaaaacacttttggatgaagtgcccagaaatagccccagttcctttcactagaatcagcttgtcccaggtgaatgccggcagagcagggtgtgtgctccccaagaaagggcagtgaccgctttccaatgtctggcagttaggggcgatgagagtagttgcaattggcaagataaaggggaactttggaaaataaatatacttatgatagaggaggcaggagaaaaggtcaagggctgtacacatgtggaactgataatcatggtagcttggcttctatgaatgggtacatgttgacccttaagtgagcttagaaagcttgagaaatcagtatgcgtgaactgtttgaggcataagaaaggcaggattttaaaactttttttttaatttgtgcaaatttatgggatacatgagaaattttttacatgtatgtaatatgtagtgatcaagtcatggtattcaagggatctgtcaccccagtacaatatattcttattaagtatagtcatcctaccctgctatcaaacattgaatttattcctcctatcttactgtacgtttgtacctttagcctacttctccttagcctcccttcatccccagtcaccctccccagtctctgttgtctacttttccactctctacctccatgtgttcaaattttttacctcctacatatacgtgagaacatctgatttttgtatttttgtgtttggcttatttcatgtaagataatgatctccacttccatccatgtagctgcaaatgacataatttcattgtttttatggatgaattgtattccattgtgtagaagcaggcagaattgactctgatagtagtctagctggaagagaggctatagctacaaagaatcttgacttaccaaaacactagtaacatgtctgtgaaactgctgtagtctaactcatttactactatgttaatttggagcgtgaagttcatcagtggaatgggtactataatttgcgaagttcaagtgacaattctggtagataaagtttcaaggagcagatggtcacaactgtcagtctcagaagtaatttggtaagtaaaatagtcatttatttggaagttttttggtaacctaattgtgatctaattgtcaccagttgggagtctaattccattttcatcactcatctgcagaaaggtgagagaaataagctattaattaatagccaatatttacgagctcttactatccaccataaagtatgctaagtgctttatgtgcattatacttaattatagtaactttctgaggtagttactattattatttccagctagttagtggaagaaccaggatttgaatccaggcaaactgactgcagagccctcacttttaacactacacataaaactgagtttatttaacagaaaacactgtcctttaacctgagattgtgtctacctttcaatactaaaatgtactttttatatgaaatggtggtgatagatgatgtcaggtttgattttcttttttttttttttttttaagaaatctttaccttgcaaaactaaaactaaaacaacccaatgacagcactgctctccagtttaaagaaaacaaacgttcttttgctagttgtgaaatctaaatttgagaaccactgactagaaaagtgggactcttagtaatttttaaagttctttagagatttttcacctgatttattttctgatttcaacctccttgttttcattaaccttttccttaagtccacctcagccactcattcttcgattatacacaagactttgtttgccattaccagcaaccacaccactttggggatctcagatgtaagcatcttgctctcgcgctgcctcccatttttccttgcttactcctagcatttctcctgttaccaactccagcaacttggaccccactggaacctccagtataatttattctatcagttcccaatctttttgttctctctctcctctttccccagcttaacctccatggtctatcacatatatcctctttgtatacacccttagcagccttgctcctcatcttctgttgtcaaatccacaagtgtttctcagctacctgcctactctgtgccagtattctcgctgttaagcatggcttaagaaaaacacaaaaccacagtgtctgatctcactttaaatttatgaaccaaatctcaagtgagccctcagtatttcttggaacagatattcctagtattccttctgtatttccctagtccaatccatttattctcctattctctgagatgactagttcttcttctctatttggctcaacccccaagcaccacctcttccatctttaccagcagctgatgacctggaatctttacttcacggaggaaatagaggcaaacagaagagaacttcttcatcttcttcatcttcccaccacaagatgtatgattggttgaatgagagaaagactgtgatgtcctagaacttcagttgctcctatatccaatgtaattagcaacttaaattccaaaaccatatataaaaatcgatttttggccatttgagattatactctttactaccactttcctttctcttattataaccaagagttgttactatgtttgtgcctcatccaaataaaaagtaggtattttttagaaaatgattaacgggagcaattagtaaaacaagcagtaaaatacccggatacaggaaattgagccaggcttgctggtatgtgcttgtcccagctactcgggaggctgagttggaaggatcgcttgagcccaggagttccaggttatagtgagctgtgtcacaccactgaactctggcctgagtgacagagtgaaaccctgtttctaaaaaagtacttgacataggatattgagagaagaaatgctttggaactatgtttgattatacccttagcccaccttagttcttacttaagtaagttatagatgaaggagaaaagatgggaatcactttgaagattaaggcctcaaactttgtggaaaatggaggaaaaaatgttgaaaacagtcatgtgatagtttttaccttacacttttgatgggaaaattagataatagaattgagctatacgtatgttgactgcacattacattaatttaatcctgttatttacctcatattgctaacctttaaaattaagatttgaaaaaaaagagatgggtaaaaccaaaaaggtcaaaatttgtatgccagcttagatgaaatttgtatttatagaactgaataagaatctacaccttacctaatactgtgaattgcttatgtaaatacaacaaaggatggtccctcgatgacctgaatctcatatgctgagttcacttagtaacagcgtccgtctgctcagacacattttcccaactccccatgtgctttccaaacctttaccatgtttcccagtatcctctcttcatccctcattttgttgatgacctagttcctgcttcacatagtcaacagaacccaacaggaataacctcagctttcttcctccttgtccctttatttaactggtctcagaaggagaggtgtctttacaagctctccctctccattcctcctctgttgccaaagttcctgaaagtgtggtctccatatctgcttatgctacttagttttcttctaagtgaaaggtagggactcaaccccaaatgctctgaccctgttcgaagaccctgtggcctagagcggcatgtatttcctgatttctaaacctagtgccctttttccaggcctcatcctctatcactgcagcatttatctctgttgtcacattcttctgcttaaaacttttcacagcttttcacgtacccagggcaggcattcaaaaatattgaagcagtagttttgatgtcttttctgagctttcaccagtatttttaataggcactactgcctaaatgtcaaatgccttatagccaaaaacaagtaatgatttcctgtaatctccaaactgattcctcttcctcttgctatgtcttggtatccctgaggttaccatcattttatccatgtacccatgctagatgcctcaaggtcatccttgactcctcttccttctctggtttccatttggtttctaagctttgatgagtatctcccgcatcttcttttctttttctactatttcctatgactcttgcctctttctgtttattgtcttttgtctggattatttcagtaatatgttcaggagtttctaatttggattccatggatggacctcaaaggattaaagaactctctcaaatttgtatgcaaattttttgtgcatgtgcattttcctggggaggtccattagactgttctgtgggaaagagaggaatagaatgagagacaatgacaatttaaatcaggtccactgatttctcgttctatacctggcctttgttatttaggtcactaacctaaggcacttatctctgaggagtgaggtggcatgtaagatattaagaataaaacagcagcattagtcagtccagctgggcagtcagtccagcagccagagatcagaggctcctcaatatcagatccaggctttaatatcctagagaagctcaggagaaagctggggcatcagcaggagcagagggtgtcctcccgaggcccctggacccatttgttcctgtgcttccaaaggacttagagggatatgaaaacttaactggcaagaatccagagtgagttggtatccccagaaaaaggttcagaacattcccccagctagcctcccctcctttgcctgtttggtctctcgttctttctccactctgccaacacagttagcttttaaatacatatctcctggtgtgccttccgtgattgtcacttacacctaagggtgattagactaatcacccaaaaatgtggggttttaatcacctatgaaacaagttaaaaaatcatggtcatggtttcaaggcctgccagttaggagcctgccagtctcgtcgccaggcactgccctctcctcacttccagggctctggctacagcaggttactactggctgtttcgagagaacagtgtctgtgtccatatccctatgcctttgatcatgctagtctctctctttggggtggcatttcctctccattgcctgtgaacctcctactcattcttccaggcccacaatggatgttagctcttcacctgagtccattcttaattttctgccatcactctggcagaatcagtatctcttggctagagtccaaaaacatttcatacatatctctgataatgtcatattatattgtagatagcctatttttatttctgtctttcctactaagccagaaatgccctacagctagggactgtctttttcatgtttgtatccctaacagctacctttgcatctagtctaaacatgagcttagtacacttttgttgaatggaattagttataaagagtttttatgactcatttaaaattagagaccaatgcttacttaataagtcagaataggctgtaataataatagtaataataaagtcccatttccactgcttattcaagtaacagcttcctttgtggaagtacattttgaaagacttcacatgtcagtgtatatttttgatgtgctcatttgagatcctaaaagaattatagttctaaagcagactagagcttctattacattcctgttgaagttatattaaatatattctatcgtttcacatatctgtattatatataataagttgcatgggtaaacattttatctcttttaaacttcatggtaataatttgtgaattgtttattttataatatctgagtaaatttagttcaaaacacattaatttgagcattttctgtgtacagaagcatagttgcaaagttaagattcttgtgtttatgttgttttgttaaattcggaaagtctcagtcttgcaaatgtattttttttttaagtatttaaattagctcagctatgagaataagcacggtccataaattaagagcttcaaataattttttaaaatccttcatattctttgagttttgtaggaaaagaatcaacagtttacttattcagcctttcctgaagtccatagtaggtgctgggcatcatgctgggtgaatgagatagtacttgcatttgaatagtttacagtcttatagcgaagaagccatgtaaacagagaattgcaatataaaccttggaggagaggaaggaagactactttgagaaccgagattaggttgagaatggatgagtctgctgatcaatttatagataaagaagcagagaggtgaagtctttttttttttttttttttgatatgtgaaataggaacctaggttatctctaagaattcatagcagggggtagctcttgagaagaacagtgaagatctggataattaataaggagaattagagatgagctaacaaagacaagtaaagagtggcatgagaaagcagtgagcatagaactgaaactggatagcatgaaattctggaggtatcagtcagtagcacagtggtataattttctccagctgtgctatggagaaattatacacattgtggccaatgtgtagtgaataaagccatattgtattcagggactatggggtggttataacagaaatttacaaagaataaatagttaaaagtccttcaaagaaagcatggcttactagggaaggcagtatggttaagaggaagttgataaacttggagaaaatgtagaagtcaagaagttggagatcagaagggctggtgctttgtaggaactcagaaaatcttcattttcttctttctggatgtcctctccctatgaatgtttcaccaccaccacctgcctcagctacagtttatacatatgaatagtttcaaatcatgatggtaacagttggctcagagggcaagattaggagccagacttcaacgtgctgctaatccagcgtgtccctgtaacttagatgctggtagtgcttggtggtattggcctctaggagaagctcaaggcttctcctgttatctccctaccactcatacttggagggtgagtcaaaggccaaaaagcattttattgggcagtggttcttagggaagggatttactctgtgatgcagagggttaagactgtaagccatcaagtgtttcccctccctctccatgttcaaccaaaggcacagttcttattactttcaaggatttaaaaaggagtcttttctcagcataaaggaggaagtgaagaccaattttgacagcccaaagggtcttcctcctcagaatctaaaatttctaatagagttgtttgcatcttgtgattttacttgagtcatcaaatgtattgtactttttttcttaaagatatacttcttaatgctttcatttcagataaggacaaaccattttccatggcgacacactatttatattgcattttcagaaatttccctttttacccatacttaggagtgtgacactgaaacctgataatctattatttcacagagtgcttttttgggtgtaatataaagatattatataattttaataacctttgaggtacaagtggtttttggttacatggatgaattatatagtagtgaagtctgagattttagtgcaggacccattgtccaagtagtgtaaactgtacccaatattagttttttattcctcactcccctctcactttccccacttcttaattttctgccatcacaatgtgttgcccaggctggtttcatgccctcactttccccacttctgagtttccaaagtctattactctgtacacctttgtgtacccataacttacctccctcttgtaagtgaaaacatatggtatttgattttccattcttgagttacttcacttagaaaaatggcctccagctccatccatgttgtagcaaaagatgtgacttcgttctttgttatggctgaatagtattccatgggatatgtgtgtgtgtgtgtgtgtgtgtgtgtgtgtgtgtgtgtgtgtatacacatatatgatatataataattatatataatttatcgttatatgtaaaacaaagcaaattttttatttttatagagacagggtcacaaagtattgcccaggctggtttcatgctcctgggctcaagtgagccaccacacccagccaaaaataagtaatatttcccagttagacattttcagagtaaaaagtatttgttcaaaatcatagcatgaatggactcttccagagacctttaactggcagcatttccccctcaaactttagtacagttataggaattgtttctggatttttggctgtatattcttgttcatggctcatggacattaacatatgtgaatggcatcactgtgtttttcctaaagtgcatacgaagaagaaagaacactttcctttagagtcttacttagattctagttagctgatataagactgttttcttttccttttcaggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggagggtaatgtgaacataagtgtgatttagtaaaagtttatcactcgctatacgatgaatgagacccagagttatggagacaaacttgttgctttgatttatattttgaagcaacttacaggtaaatttacctagtacctaggttatatatggcactgcaccagggactgtggaagatttacgtgatgagcagatgttgttgcccacatattcctataaacaaaggtaggtgattgtgtaagccagaggttttgcaaaaataggtcatgaatatattttcaggtgacacttttattccatattgcttccagagacttgtgctcatttatcctttggaagaaaaggggaaattaaatccataaatagacttatgaaatcgtattatgtaaggttcatatgcaaaaagctatcttacttaacactgagtcttgctcagttatagagtgacaggattgagttgtcagagctcaaaggaaagcttgatttgcgtctcagaaatgaaattatttaaaaatcaagctagaatttactaattctgatagttttacatgtcaacttgactaggacataaagtgcctaaatatttggtaaaacatttcggttgtgtctgtgaggatgtttctggatgaaattagcgtttgagttgatagactgaataaagcagattgccctccctaatgtgggcaggccccattcaatcagtttaaggcctgaacagaacaaaaaggcttactttcctgcaagtaagagggaatttcgacttgcctggttgccctgagttgggacattggtttggatgcacaccgaaacatcagctcttcctggcttggaggcctttgggctggaactaaataatgcgtattagctctcctgggtcaccaggttgctgacagcagatcttgggacttgtcagcctctgaaattgtagatttatcccaaggaattggctaaaacgattatggaggctgacatatatatgtgggtgtatatgcatacatacatattcatagagatttatcataaggaaaacacacacacacacacacacacacacacgaacattctattggttctgtttgtctgttctgattaattatcctaatactaacatatttttttcattgacagtttaagaacaatgccatgagatttctggttctagcaatacagtagactaggtaaccagaaaaccttccttctataaacaccttcaaatgctaggtatacactgtaccccttaaatatgcacagttatgtgccaattaaacacaaaataaaacttttaaaagttctgggtaaaacataactgaaatcattttaaatgcataattgagctcttcagaaagaaaactggatctccaggaaattagagtcgtaagatacgggctgcagcttttggtttcataatatatgggtttgggttttagtacccactagggaacagaacatgagtccttgaatccatttacagtgtggactaggaactggtaccttcaaaggggttgtgtctatgaaaagagtggactagaaaatatctgctgctaccacagggaaattaacaaaaaatatttaactgcctgggttctggaatggaagctgggaaatctcctatgggaattcttcttcttctttttttttttttttttttttttttttgagatggagttttgctcttgttgcccaggctggagtgcaatggcgtgatctcggctcaccacaacctccgcctcccaggttcaagcaattctcctgcctcagcctccccagtagctgggattacaggcatgcaccaccacgcccagctaattttgtatttttactagagatggagtttctccatgttggtcaggctggtctcgagctcccaacctcaggtgatctgcccgccttggcctcccaaagtgctgagattataggcgtgacccaccgtgcccggcctcccatgggaattgtaaaccatggatccttgttcatgctggtttagaatttgaatgaatgtatgctacctatgtggcttgaaacccgaagctgagaaattagttaaaaaaattattcaggtgcagtggctcatgcctgtagtctcagctacttggaaggctgagatggaagggtcactagaacccaggagttctaggctgcagtgagctctcattgtgccattgcactccaacctgggtgacagtgcaagaccctatgttaaggaagaaaaaaattagtcctgggctagtgatagcataagttgtcagatataagcaaaccccagggggtgctccaacaacctaggctgaaaggaatagaaaaagtagtcatgaaaatttaaaactcagcaaccaagtttaagataagacaacaaatttcagctgaagagagaagtggtaaacagaagaataaacctaaagaaatcacccagaatgtagcacagagagataaagggatggagaagatgaaagttgagatgagagagttaaaacaagaagtccagatagaatagtgtagaggcattattcaaaaagagaatgactaagaatattctagaattaataaagacataagtactcagattcaggtagcaccatgagcctatatgggataaatgaaaattaacttatttctagacttgttataggagaatgccaaagaaaaaaaatcttagtaacaaaagaaagacatggagatgacttacaaaggggtatccattatgttgatagcaaacttttccatgacagaaagagagaacaaaaaacagtagaataatatcttcagagagctaagtgaaaataactgtcaacttaaaagttaatacccagcttaattctcattcaggaatgagggtgaaataaagactttttttcttcaggcaaaggataatagaattaactagttgcagaagcttgttggaagattatgaagcaagatgtactgagactgaaggaagttgaacccagaaggaaacagtagagccaagaaacaatgatgagcaatgaaattggtgaaaatatagataaagtctgggagttctacttctagtagtggcaaattaggtcatttgagtcatgtgttccactgaagactaccagaaaagctcaacacaatatttaaacatgttttgcttgaaggtatcaaagaagaaaaatggaggcctagaacaaaggtcctcctggtatactgggtcactgttcctctcgagatattagccagttctgcaggaagctgctaaaacctaagcagcccttttgacaggctagtgggagtaatgggggcagagattagtgcccatggcccctaaggaggggacacctgatgaacataactcattttgagtcaagaccctgaagggctacaccataggagcaagggttaaccaggagtagacatactctcactggggctgcagatcagctttgaatcatgtcagtccctaaaattagattgagggttcctaaattgctagtgcccctaggcatctggcagaattgtaaatccttcctggaagaaagtggtatcatgtaaggtcacaaattgtttctagtttgcaaatgcaatgtctggcttataatcaaaagcaactggaaacagatacacaaacaacatcaagaaaaagaaaagatggttcaaacagcctctagatattggaattctcagatacagacttttgaaataattatacttaccacattcaaggggataaaagacaagacagatttttggcagagaactggaaactaaaaataaacaaatataaattctagaactgagaaaatcagtaagtaaaattaactcaagtgaatgagtttaaatagcaggttagacacatctgaagagagaattagtgtactgaaagatataagatgaaaataaccagagacaaagaatgaaaggaattaagagagagtaagagagagagagagagaataccgtttaaaggtctggtgcgtgtatttaaagttccagaaaggcaagagaaagaggatgaatcaaaatcaggatttgaagagaaaatggtttagaactttctaaaactgatggaaaacattagtccataaattgcagaaatgatatgaaccctgagcaggagaaataccaaagaactctacatatataggcattattgttaaattgctgaaaaccaaaaatgagaaaaatcttaaaaggagctagagagcaaaggaaaattaccttcaaataagcaacaactagctagtagctgtcttctcaatagaaatgatggaaacaaaaagtcaatcaaaggccatttttaaagagctgaaagaaaataactgtcaacttagaattttatatccagtaaatggatgaatgatcatagaaatatataatggaatacaaggcagtaatgaaaataaatagcctacagctatatacagttgtgaatctcacaaataaattattgagcaaaagaaaccagatttcaaaaagaacacatactgtgtgattccatttatagagagcttacctaaagtatagtgtttaacaacacatgcttgggtggtaaaactataaaggaaaatgaattattaccataaaaatcagattgtggttacctatggggaaaggtcagggaggagtgcttgggaggggttgtgaggaggtgctcccaggatgctagcagtattctgtttcttatgattacgtaggcgttcattttgtgacagttcattgaggcatatattcacattttgtaacttttctctatgtgtgatgtattttgcaattaaaagttttaaaaataaattttaatagcattcactgagaaaaacaataatgatatgaatatttttaaaggatagaactaaaatatggaaaaaaacgtttgggaagtagattaaattcatgtaagctccttatattattggggaagatggtagggagtttgagaccagcctggtcaacatggtgtaaccccatctctactaaaaaaatacaaaaattagttgggcttggtggcgcacagctgtaatcccagctactcaggaggctgaggcaggagaattgcttgaacccgggaggcggagattgcagtgagccaagatcgtgccactggattccagcctgggtaacaaaagtgaaactccatgtcaaaaaaaaaaaaagaagccaataatgttagttaacattaagtcaaatgtgcatgtgaaagttgtacattgtgcccaaacttttccaaagcatagggaggagctgggaaagaaacaatggaaactcaaatactttagaaggcaagaaagaaataacaagactcaaagacaatgtgatgataataaaaaggtaattttaaaaacaatttcatttatagcagaaatcagaatgtaaagtgcctaggattcgatctagcaggaaatgtgcaagacctttaaggagaaaattctaaacatttttgaaaatctttttttaagcagctaataaatggtaagatataacatgttcatgtatgggagaactgacaatgtcataaaaatgagttctgcccatcttggtctgtaagttgagtgtatttccagtgaagcctaataggaattttttaacatttgacaacttgattctaattttttttgaggcttgaagagttatgagaattttgaagaataatgaagatttacttttatcacatatcaagacttactagaaagcaatagtaattgaaacaatgttatatattcatgtaaaaacagaccaaggaaacaatagaacacaggaaggaagagcctgctctatgacaagtgatgatacagatcagaggggagtaataggctggctgtgccttaaacggagctgagataattgactacctatttggaaaaagataaaatgcaattcctacctcacagcatacaaaattgcaaatggatttacaaaaaaacaaaaacataaaagcctactaaaatttataggaggaaaacttatttagaagaaaaataggcaaaaatgttttaagatttgaggctagggaagaattgatacagaaagtaaatccattggaagtgttaatttggctacattaatataaagaaaattctgtatgacaaattacactgaatacaaatgtctcaaactgggagaagatatttgcagtgtatataatctacaaagaattggcatcctctataataaattctctataaaaagtcttgtataataagaaaaatataaataccacaatttaaaaaaactgtcgaaggatttaacacgtagttctcagagaaagaacacaattgaagaaaagcaaatgaaaagatattcaggaaaatgtataataaaagagggattatttcttaaacaacctggcaaaatttacaacagctggtaaaaccaagagtttgtggggttatggagaaacaaggtctcatatacattgctagttggagtataaactagaagaatataccaagtgggtagtatcttgcaaataaatttgacatcttacaaaaatgaaaatgcacaaaccccatgagttctacttcaagaccactacctatgataaacaacatgacatgtaccaggatgttgattgtcatgctatttgtaatagagggaaaagaaacatcattactcttccttagtaggaaatggaataacatacagatattaaaatgaatatgctgagcacagtggcccacgcctgtaatcccagcacttcaggatgccaaggcagaggatcatttgagcccaggagttgaagaccatcatgggcaacatagtgagaccccacctctacaaaaattaaaaattagccaggcatggtggcacattcctgtggtcccagccacttaggaggctgaggtgggatggtcacttgtgccggggaggtcaaggctgcagtgagctgtgatagtgccactgcactcccgcttgggcaacagaatgagaccctgtctcaaaaaaataaaatgaataatagatttacatagatcgacatgaataacactcagaaatataacatcccgtcttcaaaaaaaaaaaaaaacctagtaagctgtactgaattaatctatcctaccatttaaaatttttgttgagggtaaaataatattaaatattccctttatagcaatcctcttagtgctttaagtctgcttgttgggtccttaattgtttcaattttatacaaggtcgtttcctttcctgctttccagcatttcattaagttcttgttcaggtctccagctagatcagtctcattggttctagcaggtgtgggtcttggtgggttggtgcaagtccattcactatttcaactcttcagaaagtcccggaaccagtcagttttgcagttcattcctaatactaagattgtttctgcttcacttatctttttaacttacctcagtgtaccaagaaaaacagtcatcaccatatactatctaggttgaataaactccgcttaaaaattattttagattattttccaaataatttacaaaatacaagaataaagagataaaaaactattaaaaattaaataagaacttaaatatataaataaaatttttatgccatgtttccctggtcttgaggtgttttggattttggtttttggaatatttgcatatacattaagatatcttggcgttgggactctggtctaaacatgaaatccatttatgttttgtatataccttgtacacacagcctgaaggtaatcctgtacaatattttaaataattttgttactgaaacaaagtctgtgtacattgaaccatcagaaagctaaggcatcactatctcagccactagatgtggatggtctgtggttggttggcatcaccattgtttctgagtgtaaatttatatgcctgataaataatcgttttcatacatgtattgagacacaagtacttaacagtaaaaaatatgacacaccattaatacagtgaaaaaatagtgagtttagggtaactaagcagcacaatggcatcaccagaatacctggataagctgttaaacaacagcaacaccaaacagcaacagtttcagtcaccacctacgatgttgtggggggcttttgttttggtttggttttttgagatggggtctcactccatcgcctaggctggcatgcagtggcaccatcatggctcaccgcagcctcaaactcctgggctcaagccgtcctcctacctcagcctcccgagtagctgggactacaggtgtgcaccaccatacctggctaattttaaaaatctttttgtagagacaaggtctccctaggttgcccaggctggtctcaaactcctgggctcaagcgatcctcctgcctgagcctcccaaagtgctgaaatgacaggtgtgagctaccatgcccagctgatgttgtgttttgattaaaagattatcatacagtaaccccctgtgtgtggtgcacctttcagattttggaacattttggattttgaatttttggattagggatactcaacctgtataccccaaatgggcaggagcctctgaatgcagtaactgttcatcagctgtcctgcatgaacttacaaatactgattctaagtttcaaatacatctttgttggcttctaaattattattacttctggttcttcttgcacttacagcatcaaaacataatgctttaagaatttttttgagatctttggctcctaattttgttgaagagaggatgaccattatatgttccacagttgcaaaacatttttatttttagatttgtagatacctttcagaatgatcaattctgttttttatggtcaatccaattttttaatgtctacttcatctatttcttctggctatctctctgtaatacctgccttcagcatctgtctacttttaaactatatcaagaaaatttggtgcacaaatgaaataaaagatgaaagaatactgtcatgtgtccttttagcaaaatgggatggcctcatttcttgtcacaagatattccacaaagaagactttctattgaataagtaactgaatgaaaatgctttgtccttagattaaaagtatattattcactcattgattcttgagtttgagaaaatgtatgtagggcatcatcatctgaagacacatagactgagattttacttataatcatcaatttcagcatctttattagagtcctaagtgctcctatcttattctttgtgttcaacttctgactcatctaataattctaaaacagtttcctcagattttcttcgtcattctggctagagaacttacaaatgttaatgcttaatcgtattcaataaaatgtagaatgaggtcacaaaagatgttagctccagacttcttttatgccttcttgaaagataacacatatcttgcacaacacagtaagaaaactgaagagtgatgtcatagtgatacttgtttcactgtttctaagtaatttagtcattttttattatactttaagttctgggatacatgtgcagaacttgcaggtttgttacataggtatacacatgccatggtgactggctgcacccatcaacccgtcatctacattaggtatttctcctaatgctatccctcccctagcccccccacccactgacaggccccagtgtatgatgttcccctccctgtgaccatgtgttctcattgttcatttcccacttatgagtgagaacatgtggtgtttggttttctggtcctgtgttggtttgctgagaatgatggtttccagcttcatccatgtccctgccaaggacatgaactcatctgtttttatggctgcatggtattccatgtgccacgttttctttatctagtctatcgttgatgggcatttgggttggttccaagtctttgctattgtgaacagtgcctcaataaacatgtgtgcatgtgtctttatagtagaatgattgtaatgggattgctgggtcaaatggtatttctggttctggatccttcaggaatcaccacactgttgaaacagcatggtactggtaccaaaacagatatatagaccaaaggaacagaacagaggcctcagaaataatgccacacatctacaactatctgatctttgacaaacctgacaaaaacaagcaatggggaaaggattccctatttaataaatggtgttgggaaaactggctagccatatgcagaaaattatacaaaaattaactcaagatggtttaaagatttaaatgtaagacctaaaaccgtaaaaatcctaaaaaaaaccgtaggcaatacctttcaggacataggcatgggcaaagacttcattcttctattttcttattttaatcctttttaagcatagttgagaataattgatgagtaatgatgtaatttctagtgtgatgaaatagcataatgtgtcttagattcataaaaagatctagtagatccaaatggcaattgtaagatagaattttattctatttttttaaatattgggttttttgttttgtttgtttgctctttggaaaaaggaaaaaagtcatgagatatcaatttttataaatagtactacttaaaacagaaactcagaaactgagattgggtctaacggaccctaatgagatactgaggattaaacactaggcagaagtgagttaaaatgccatatggagaagcattttataacatctcagttgtgatagttaccacatggctacataggtaactttggtgctgtttttaaagttgcaagcaatttaaatattaaactactgatgataaaattgagttagcaaagaatttccagttcgatattaattatagccagccttttcagttatacctttctcacatccagaaatggcttgatgtactcagctaatgacctcatgcaggatatatatgtgtgttacatgataaagaaaaacatcacttctgtaattttggacagtccacactgacggagatgaacacttgcatataggtcaaactagttaaatacagaacagccgcttttgaaagctgttgccagggctcaacagcgtcagctctgtttctatggagaaagactttgcagatgttaaaaacagagctagaagccaatgaatggaagaggattgtgctgtggaaatttaatttttttgataaagggtttattgatgaatcagctatattagtctgtgaacgttaatcttgacatcttctttacccaattcccaatttcttggaataagatcttgcttttatttaagtaacacacaatgtaaaatttgatgttattgtactgactaggtggggtaagggacctgatgacaggtaacaagattagtaaggttctgaaaaggtcagaattgtactgaattatgtttagaacagattgcctccatgatcatttaatcaaacagtgttcgtattgtctttgtccttgtccacatacgtgatttttgaggttgggctgagaaggaaatcatgattccatcaacaacataaggcacattgacagtaaaactcatatattatagcagctttttgtttcatgctgtatagggcagacaaccttgaagaaaaaaaaaactttaaaaaataatgtaaaatttcacagtttttcagtcacaaacagaagtatccttgttgtcactgaagatgacaagaattaatatcctgctgtatagaagtactttggcaaagttaaggttgtagttccaattcctcatttccaattttttctccagatggaaagatgaacagtttttggtattgaatttttttttaggaagcaagttatttatcattagatatctattcagtaaatgcaatgatacagaaaaatgaagtttttttccctcagatttgaaattaggttttaaaatatggagggagaacaatttgtaagtaatgttcaggaacaaaaataaaacctaatgaaactttagaaactttgatggacatctgtcatcctacatacaattgcattaaagaatagaatttattattattttatctggtttattatgctgtaaaatgaatttttctctttttgtatgtagttttatgaaatttcatacatgtatagattcatggaaccactgtaaaaatcaggatgtagaacatttgcatcacccccaaaaactccttcatgcagtcccttactggtcaccctttctttttagtaaccctggtaactaccaatgtgttctccatccctgtagttttatcttttcaagaatgtcatataaatggcgtcatacactatgtaacctttggggactggctgtcttcagcataatgcctttgagattcatccaagttgttgcatgtgtcaaacatccctttttattgttgaatagtatttaattgtgtgggtgtactatcatttgtttatctcttgacccactgaaggccaattgggttgttttctagtttggggcaattatgagcagagctgctataaaccaagtagtggaatttttaggtcatatagcattttatctattttttatttaaaaatatatattcagggtttgtttttgacccagttgaatttccttcaggtcatttttggaactctttcttcctatgtctgatgtaacatttcatctttcatctttgtcatttttttattcccccttttcttcagattactataggtatattctggtattgtagcccagaatctgtcctgcttttatattcctccagcttaattatatgatccatcttcttacggtatctacggcttgctacaagactattctttactatttgcagaagacgttcagatgtatcttgctatccttttttattcagttgtgtatatcttgttctctatttggaggcctttccaaatagatgtcttgttaactctttaatcttatcatgctagaaacaaacaaacaaaaaaaattcccttgtatcttttcccttctgcagcttccttatcatactacagggtaatttcttttcttcactgtcagtcttccaccctacatgcaagcaataatcaaatctagcatttgctgtttggtcatcaccactcctgtcaccaaaattctcattctgtttagattctgcttgcctcatttatgtaccattatttgtttctcactgaccttccaagtgcatacttcttttcatcctaaagccaagaataaaatcattttatataaagagcattctactttgcagttcatttactgatgtcctctgtttcagtaggaaggcctaattctagatttcagtctgtcatgatagtactataacttctgcttctcacattaggtaaattttattatcccttttataggaccttgactgcctctgggccttctgttcagttgaacccacatgcttctaacttcttagctattagaccctctctttccccttttatatgtctttgttttggtacagcttctcatacccaaaagcaggtatacctgttagtaaggaggatacaagttgtatttgtaggtggtatgattgtctacctaggaaattcaaaagagtcagatttttttaaaaacttagatattataaataagagtaaagtagccatatataaaataaatacataaaaatatatttccttcatacttctatactgtttctgaaatataatagaaaaatcccatcacaattgccaccaaaaaacatagctaggaatctttatgaaggaatgaaggaatttaaacaacaaaaactataaaactttattgggaagctgggcccaatggctcatgcctgtaatcctagcactttgggaagccaaggtgggaggatcacttaagtctaggagttgaagaccagcctgggcaacatagtgagaccttatctctaaaaataaaaataaaaataaattttaaaactttactgagagacgtaaaagtgttgaataattggagaggcattattcttctaaaaaaccaaatatgctatacagattttagtatttcctaaacttagatatttaacctaatttcagtcagagcttgggtttttgtctgttctttatttttttatttttaattggtggaggttattccccctcataagaatgattctgatgttcatttggaaatacacatggttggaaatagccaagatagttatgaaaaagaagaatgtatagaggagaagagcttcttcaatgtactactgtaaagttatggagataaaaacatgaatgaatccattgagcagagtagacaggctggtaataacctagcatacatcaaagtccaaaccttggtatgatggcagctcagtcaacgaagaaaggagggataatttagggaacaatgctgggtcggttatttgaagaagaattagttggcttctcactttacttgtaccatacacaaaaataaaacaccagataaagaattatatgtaaagcaaaaatttaagaaaagaaaatatgtgaccatcagtgtctgtaatggggaacaattttaaggataaaactaatgaaaataccataaaaataaaaattgtgctggctgtttagtagaaacagaaaacgccttccacttaccgaaaatataccataaataggctgggcacagtggctctcgcctgtaatctcagcactttgggaggccgaggtgggcaaatacctgaggtctggagtttgagaccagcctggccaacgtggtgaaaccctgtctctactaaaaatacaaaattagccagacttgatggtgcacgtctgtaatcccagatgtgagaggctgaggcacgagaatcgcttgaacctgggaggcggaggttgcatgagcagagatcataccactgcactccagcctgaacgacagagcgaaagtccatctcaaaaaaatatatatacttatatatatgcacacatgccataaagaaaagacaactggcaaactagaataaagtagttacaagtataataatggccctaatgtataaatcattttttaatcaataggaaaagctcttgaatttcaacagaaaagggtatagaagacatatcaaatactaataaaattaccaatggtaaaaacatgattttttaacagcaccagccccttcagtaattagataaatgtgatttaaaaacaacagaaagatactattgtccatctatcaaattgagaattacttttaaagtgtttctaatattcattacttgtgggaatataccaagataggcactatcaggtactgtgctgggattatagattgataaaacctttctggaaaagtgtttctactttttcaagtgttcctatttcaagggccttaaaatacttaacacaccttttaacctaacaatttgcctttagcaagtattcatctatattgtcaagcgtttaagtataaaaatgttcattgtaggctgggtacagtggctcacatttgtaatcgcagcactttgggaggttgaggcaggaggatcacttgagtcctggagttcaagaccagcctgagcaacatggcaaaaccccatctctacaaaaaaaaataaaatattttccaggcgtggtagcacgcatctgtagtcccagccactcgggaggctgaggtgggggattgcttgagcccaggagtttgaggctgcagtgagctttgatcgcaccactgcactccagcctgggcaacagagtgagatcctgtctctacaaagaatgaaaaaagaaaatgtttattgcagcaacatatataatactaaaaacttagaaataattaaatatctaacagtaaggaatgaatatggagtaggagagttaaactgtgaaaccattcatatgattaaatattatagagctattaaaaatcatatcatcggccaggcgcggtggctcactcctgtaatcccagcactttgggagggcaaggcaggcggatcacaaggtcaggagatcgagaccatcctggctaacacggtgaaacccatctctactaaaaaaaaaatacaaaaaaaaaattagccgggcatggtggtgggcgcctgtagtcccagctactcgggagtctgaggcaggagaatggcgtgaacccgggaggcggagcttgcagtgagccaagatcacgccactgcactccagcctgggcaacagagtgagactccgtctcaaaaaaaaaaaatatatatatatatatattgtatagggatgggaaagggtttaaaataatacctgtactgaaaaacaggatgcaaggtattacatagctccattttggctgagtttgagatgattgtgatttctttattttttgctattttcccacattttttataattatatattttgcaattggaagcaaaaataaccattgaaaatcgttttcaaagaataatattcaagagaatacaaggtgcagtaagttcttaatatttagttaaaatatagaaatctgtggaccattaacagcacttatctttaggtaatgtaatgatgttttatagatgggtctttattgatgggatgtcactatgttgcccaggctggtcttgaactcctggcctgaagcagtcttcccacctctgctttccaagtagctgggattacaggcacaagccatggcaaatgtagtatattttaatttatgtttttagtgatggaatctcactgtgttgcccaggctggactccagctcctgggctcaaggattcctccagcctcagcctccagagtagctgggactataggcacgtaccactctgcccagctttatttttacactttatttgttttacaacttttgctctgttaacaaatctactactcctttaaaaagttaaaaaacattctcttattaaaacaaagattaggctgggcatggtggctcacgcctgtaatcccagcactttgggaggctgcgctgagtgaatcacctgaggtcaggagttcgagaccagcctggcaaacatggtgaaaccccgtctctactaaaaatacaaaaattagccaggagtggtagcacatgcctacaatcccagctactcaggaagctgagacaggagaatcacttgaacccgggaggcagaggttgcagtgagctaagattgcgtcattgcactccagcctgggcagcagagcaagacttcatctcaaacaaacaaacaaaacaacgattatatccttatcagagatttaatggatactaaccatatttaatcctcagtctcattatgctcatttaatttttattatccgtatgttgtcatatttaggttatgttcattttttaccagttttgttaatccctagtgttttttgtttttgagacggagtctcactctgtcgcccaggctggagtgcagtggtgcagtctcggctcactgcaacctctgcctcctgggttcaggtgattttcctgcctcagcctccagagtagctgggattacaggcacctgccaccacacccagctaacttttgtatttttagtagagatagggtttcaccatgttggccaggctggtctcgaactcctgacctaagttgatccatcctcctctgcctcccaaagtgctgggattacaggcaggagccaccgcacccggccgtgttttttgtttataaaagaaaaaatttccagagtgcactttactccctgataggagactaaattacttaaatataaattttagaaggtacgtgttaaattaacctaatgaattagtagcattcagaagtgtttgtatctgttaaagattcaaaatatacaaactaatttcttttaatggtgattctatttctagtaaactaaggcagaaatcattatgcagaagaaacagcaccctgttaaccatgttctttttataaaccgtctctgttctcactttattgttaggaaggcgtaatctgttttcatgtaatataagtacatgtgagtcatgttgagtttcttcactcatttgtccaattcccagtcaacctgtaggtggagttaacctttagttacataatataacgaaacaaacattaaacctactgcttctgggacagtcttctcaccaaaattcagggaaaatgggagggtgttgccactgactgacttaatgaaagtatctgacaaatgtaaggtctttcaaatagtgagataagaaatgtatataaattatttgatcgactacttactttctatctatacacacacactatcagtatataatgtgtattttcattttatagctattaaatatgaggttctagaatgagttttcagtttgcagaattctgagaatctagttccaacacctttgagaggacaacaaccacaattgcacttgccatatttattagtcaaaatgaagcgaagtcaatctgttgaaagctttgttttgtttttctgattagtttgtttaataagacattcaaattatgatctttaatataatttcttcccctaatagcttggtgctaacagtggtttgcacatcatcatctttgatgaaattgatgccatctgcaagcagagagggagcatggctggtagcacgggagttcatgacactgttgtcaaccagttgctgtccaaaattgatggcatggagcagctaaacaacatcctagtcattggtatgtttactttttaaaaaagtactattcattcaaaaacgttagccataagttctgaattaagatgtgtgtaggttgtgattaaactgttttgccagtgtttccaaattagaatccagtgatattgaagaatctattgtaatgcctaggcttaataggaaaaataaaagatggatttcagtcacttgtaggtttaagcttatagctcacccacaggtgaaaaagatgtaggttgaagcttatagctcacccaaaaatgaaaaatacacatgaaacaatggaatgcagtggttttcaaactgggtcttgcaggccttcaggggtcctcagaggtgctttcagggtcagtgagggccagggagtgcgtttcagatcctacatcactattataacttcctcttttagctgttttatgtactgaggtgcttctgaagatgacttctggggaaaaaaaaaaaaaaacaccctgctgttttatgaagtctgaaaaccactggcctgtaaaaaagagaaggaactttggagtcagagagatcgtgtcacattgcccctctgtcactttgacagattatttaccctttgaatcttaaattttctttttaaatactggaagttttcataacatttatattccattggcttatacagtagtgaaatagtaaagcaaagtctccttagcttgttagggaaattactattcttacatatactaaaaggacatttgattttatttttgaactctgatcatttgttgttttgttttaacatctgtgttcaggaatgaccaatagaccagatctgatagatgaggctcttcttagacctggaagactggaagttaaaatggagataggtaaggagatctgtcactgattgggtgtgtggtggggggagtggaggcatttagagttcattaacaggaacaatgtcatatggtgtagtattttttagaaaaggtttatatcatgagaagtagatgtttacatgcttgagtacctataaggaaaacattaggatcataataatctcctctaggctgggcgcagtggctcacacctgtaatcccagcactttgggaggctgaggcaggtggatcacttgaggccagttgttcgagaccagcctggccaacatggtgaaaccccttctctactaaaaatacaaaaaacttagccgagtgtggtggtgtgcacctgtaatcccagctactcggaaggctgagataggagaatcgcctgaatccaggaggcagaggttgcagtgagctgagatcgtaccactgcactccagcctgggaaacagagcgagactctgtctcaaaataataataataataataatgataatctcctctgatggtgctttcgagactaggaaaatgcctattttatttttaatttcatcaggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggtcaggaaaatcagctaaacagattataaacattatgccagtattctttctctttcctttcaagcatatcaaggggtagggaaatgctgacttttggtggagaagagatggtaaaaggaataagaattaattgtcaactgctaaatcttcagagtagcaggaaggaagataatgtttgcatctgccctgtagtaaccactgactcatctaccttaggtcatcaccatctgacacagacacgtaaagtgaaaattttgaagaagtgtttttaaatctttgtattgtattaaaagttgtaatatggccaggcatggtggctcatgcctgtaatcccagcactttgggaggctgaggcgggcggatcacaaggtcaggagatcgagaccatcctggctaacacggtgaaaccccgtctccactaaaaatacaaaaaattagccgggcatggtggcgggcacctgtagtcccggctactcgggaggctgaggcaagagaatggtgtgaacccaggaggcagagcttgaagtgagctgagattgcgccactgcactccagcctgggtgacagagcgagattccgtctccaaaaaaaaaaaaaaaagttgtaatatgtcagaggaagtgggagtttccacgtactagaattttgggggctgctttattcagcaaatatattgaatagttgatgtgttcaagctattgggctggagacataaagataattgtgaactcttccctcaaggagttcagagtcaggaaaatggacatattttcaaattagtacaataatattgtagttaccatggtagaaatacgtactaggatacttttattttgataaagtgctcttgatcttccatctcttctctcctttaggttttagttaccacctgtagacagatttactgaacatatctgtctcctactttcagatttgtactaaataccctcacctagatgttttatcaggtctcagatttaatattgcaaaaccaaatttattgtcttttttactactttcctttctgctcgcatttccctgtttatcccaatttcccaggcttaaaacatcaggattatctttgattcctgacactctactgtgccctaggtcaagtcacttgccaaattttttcagttctgtcttggcagtgccttttagttctcactgccactacccaccttctctttgattaaccttcctgtatcatatcattcaaccattcagacactttcagtgattccccatcatttacaaaacaaagtacaggcttcttttgggtcttttgggtcctctagatctgaccctaactggcctttccaaatgtgctcctgattattctccacatacttcagccaaacttaaataatcaccggtcatcagacattaatttatttttcaacatctctgctttggttttgttttttttgcatcactgaggatcttcatcctctacgtttacctgtcttttcaaaacctggctcatatgctaccactgtcctcacaccttttcacattttccctttcaagaatgttatacccgtttccttcttgaaatagtaatgtatcatttatggtactgtcagttgactttggttcacagtagatttattcggcatctactgcatgctagaccctgtgctaggagttaataccccaactgcaaagaagtaaagtacctaccattaagctgccctcagtctaaccctccacgtgcagtaacagaaagtacatgcaaggcaagagagtgaacgcatgtcagatatggtcaacttgtggggtgagagaaaccttcatatgcatgtctgttggtagagcagggccttttaggtagagggaacaacatatgcaaagaagcagagacacagaatagcatagtgcgttggagtagtttagtattgcttcagcatggaagttaggggagggatggtagagagattgtgggggataagtcaggagactaaagtagggatggagcacaaagagccttttatactctgctaagaagtatggactttttttctgtgagtagtgctaagccattgagttttaagaatagcagtgacatagtgttaaaacataagatcactctggcagctctgtcgagtggagtagttagaggagtggagttggcgacacaggacaagagggggagcttttataacagttcaggcaagaaataaaagcctgaacagttaggttgagtatgtagatatttgggtatatcctatcactggttctagaccaggaatccagccaactaccagtttttataaataaagggcttttttggaacagtacacattaatttgtgtactgtctatggctgcctgcatgctacagtggcagagttgagtatttgcaataggggctgcatggcccacaaagcctattttagtgcttttattttaggtactatctgccactttacagaagtttgctggcccttgttctagactttaaatccttatcttattcacctcagagtctcccatagtaccccaaatagatctaaataatgagcacatggtaggtgtccagtaaattatttttcttttttttttttgaaacagagtcttactctgtcgcccaggctggagtgcagtggcacagtcttcgctcactgcaacctctgcctcctgggttcaagtgattctcctgcctcagcctcccaagtagctgggactacaggcatgtgccaccacgcccagctaattttttgtatctttagtagagatggggtttcaccatgttggccaggctggtctcaaacccctgacctcgtgatccgcccgcctcagcctcccaaaatgttgggattacaggtgtgagccaccatgcccagccaatattttttaaatgagtaaacttacgtaactattctgaatcacgctctatccataagtcataatttccctacataatagaggtggatttgttctagctcaagaatgccaaaggtttggatggtgtgggaatattgtattgggtctttatataatggatccattcagggactatgtttttattcttccttgtttgtttgttttgagacggagtctcactctgtcgcccgggctggagtgcagtggtgcaatctcggctcactgcaagctccaccttccaggttcagccattctcctgcctcagcctcccaagtagctgggactacaggcacccaccatcacgcctggctaagtttttgtatttttagttgagatgggatcaccgtgttagccaggatggtctcgatctcctgacctcgtgatccgcctgcctcggcctcccaaagttttgggattacaggcgtgagccaccatgcccggccatgctatactgttttaataagaagagatggcaacttcaagaaaaatgatgtaaacagtgtgaaaactggtccctaccatactgatctttcatctcagaccacatgggtgcatcttgatgtaatccacagtaactagtttactagttgtcatatttttcatatgtgttggccatggaatttttctcttatttagtcatctgtcattttaactacaataatcctatcccaaaatttcactttaagccgttgtctcagtaagaaacatgctttcttcaagcatatattgggtttatctacatatgaggcaatgagggatggtgggaagatcgcagatatcgtagtcagaaggtgtggttatgcattatatttcttccacctttttgtttctgacctgtcaaggggagacactacctatctaatcagatttttatgagaatgaaagcaaatactttatataaaagtgccttgtaaactctataaatgctagttatctccatttttttaattggctgatttgagaggatatcagtacttttcaatatatgaatttctgatttttattgactctttgtagttacacattttctaattgtaaagctaaaatgtttgtcacccttgtacataatatattatccttctgatttgcaagtaagcagtagtgcaaatagttcatgtttccatcacttttttccacatgatagaattatctgtaagcttcaggtgatatgtattgacttgcgatcattgctccttgtaccaaacagctcctaacttttcaccatatcaatggaataactatgtaggcactttagggatgagaaagctatgtaagacactaaccttacccccaaaaagaaatattactaacatttcatcttctgcattttaaaaaatctgcattgtcagaaggtctttaaagactatttttccaatgactcgtccttggctaaacaaaagaagtacagttttagtcttccattgctatagatgtttgtagctttaatagtgattgatgaataaatatttaaattgaaacttataaagttgttactgaactttaaaacattcaaaacgtacaagtgttatgatgttctttctttgtattttaaaaatccattattggtgttattttgcttccttttcaaaagattgaggcctaaagaaagatttagtcaggtggactaaacaggtctttcctgttaaactgttttttcaggttttctgagacaagtggaaaatctggtcagaaacacctgttgttcatgtcatttatacttgaacctatgattgcggtcaactaaaattcatgtgacatttggttgtttttatcttgaaaggaatttctgcttcaggttgagaagattcataacccaaattttttctctaatctgttgtgaggaaataaactgaggacacacacacacacacacacacacactttctctcacatacactttccacctgagtcaaagctctaagttatgtttacagaatttcataaaattatttcttatttttttgcagaatttttgattgattaaggtcattctacccttaatttaagaggaatgataagaactttgaaaggtcagatttaaaaggttatgaaatttaagggtgaccacttgatatttgctagtgttgaaatacaagtttattagtttctgcaggtataagctgaaagatgctgcctcttctatattgattagctgttataaataaaatgcaggaaaaatgttgctaattcaaacaaatgagaaaaggttttctgaaaaagtaaaaattcagaattatagactttttaaaattttacaaattttgataaaatgctaaaagtcagctaagagcagtccttagaaaatttattttaatgagcaggtaggaataattgacaattggaatattgatggcttacaattatgtaacttacagaattccttatgtgcctgaaaacagtttgttttgaaatacttcttccccacacccatcttaattcacttttaagaaaggactcagcaattaattgggtgagtcttttcttaataattagcaaaatgacaagttttataccagcttcagtcctaaaatctatcgtattttttggcaaattttgaaagatgggcaagatttttctttcatactgctgtatgtatctatcatttgaattcggttttactgtaagagaatcagaatgcaaaatattatggtaaaaacctaggcctgtgtaggaaagaggtgtttaaagtgaggctggtagctttgttgagattttaatgtttcggtcagagctcttgtcttccctttggcctgagagtttgtatcttgtagaatcctttcagatgtatcaaaaagtttgaatcagagttaaaacttttatataagggtatctaggaaggaagtcctgtatctgccttttataacttatggaaacccccaggtttgtataagtataaaatgagataatgtgatatggtgaaatgagatagtgtgtatgaacatactttataaactataaagaactgtagacatttgtatattattaattatcataattctttcacggatatgcttgtttcctgtgacaccatttttctttttttcttttttttttttttggagatggagttttcttcttgttgcctaggctagagtgcaatggcgtgatctcggctcaccacaacctccgcctctcgagttcaagcgattcccctgcctcagcctccagagtagctgggattacaggtgtccaccaccatgcctggctaattttgtatttttagtagagacagggtttcgccatgtaggtcaggctggtctcgaactcccgacctcaggtgatccgcctgcctcggcctcccaaagtgctgggattataggtgtgagccaccgtgccaggcccatttttctttttttaaacttagaaatgccaaataaatgcgattaatatttatcaaacctcatatgtgccaatataagccctattaataatttaaatgtttatgtttttttgtttgtttgtttttgtttttgagacggagtctcactctgtcgcccaggctggagtgcagtggcgccatcacaactcactgcaagctctgcctcccgggttcacgccattctcctgcctcagcctcctgagtacctggggctacaggtgtctgccaccacgcctggctacttttttgtatttttagtaaagacagggtttcactgtgttagccagtatggtctcgatctcctgacctggtgatcctattgcctcagcctcccaaagtgctgggattacaggcgtgagccaccatgcccagcccaataatttaaatgttaattgttctattgaagtaaaatatttgtctctttgttactttttactttatttttaaaagtatagaagttatagatgatggctttctttttgtaaaagattcaagaatgtcaaagcatatagggaaaaatgagaaaggccatctctaacaccactttcctttccctctccagagttagccaaaatttgggatatatctttgaagtttgttttctttatataatatttacattcatatacgtatgtgcttttttaaaaaaatgaacattaatggaattatactgcagtttacatttttcacttgcaaatattccttggatagctttctgtgtcagtgtatgtaagtccccttcattattttggacaaatgcagagtattctagaatattgccacataatggaaaatataagatccatgaacacagggaccttttctgttttatttactgctatgactccagttcctcagatagtgcttggtgtctggtaggtattcagtaaatagaattaatgaataatttatttaacatatggattatttctggttgtggctgttgaaaaaatactgttgtgaaaatgcttacttgcctccctgtgcacacaaggaatcattttctagggtagccatccaaatgtcttttcaaagacatggtttcattgtcttctagtttctagtgttgccagtgagagttatcataccaatctcgttctggtttctttgcaggaaacctgttttgtccctcagaaaggttctaggactttctcttcacctttggtgctctgaaagtttacagcagtgggtctggacagatgtgtgcttcttttcatttatcccgatcatcactcactgaaccctttaaactgcagaggcacacctttcttcagctataggaaatttttttctcttctgtcttttattgtttcttctctatgactctttctgttctctccttctgagactcctgttagatcacagttaaaacttatggatatttctttcatgctttgtagcctttctgtctcactttctgtcattttgtgggatttggggcggaagggaagataaataactgtgttctgtttgccatcttcacccagcttcctgccatagttctttttatcccacaaggatgacttttttttatatctgtcacttcatttgtctcacagtctcttcctaaaaaaaatatgactcatatttcataataattgatggaaggttgatatttatttaacatgcgtttgttttatagtcagctttttttgaaaatgctttttttttcaaagccatgataccaatttaaaaattaggctgtgttgttttgtgctattggtagtgagcccagtcgctttaaaacacgtgttggtatcttaatcactcatctggtccaggcagctccaagtgctgataaaggccttgatgcttctccagatgtctaaatgctagctccaggtgcagtaagcagactatttggagctggcacatagattctgaagcacaatgtattaatacaaatgaaagttttaggttcttggtctcctagagtaatggttcttaagcctggttcagtaccagaatcacctgtggtacttggtaaaactataaagaccctctaataggcctgttaaatcaaaatcctgtggggaatgggactgagcgcctgtatatctctgaaggctctggaggttattctgatatgcagccaagtatggctgtgttttcatttctgtatatattttctttttgtatggatttttcactgttcttactctctgtatgtattttttcttactcatgcctcatgagttaaaatggctatacagtgtcccttggtacagatgtgttctaatttacataactgatcccctcttggtagacattattaatatgcttcccatcttttttcataacaagttactttagtagatatacttgtacatataactttgtacacatttgtgaatatatttaggggataaattactagaagtggacttgttcagaggatatatatatttgtgaatttgagagatgtgttttctttgattccaatttttaaaattgttttaaaatgcccataaaattgtccgggcgtggtggctcacgcctgtaatcccagcactttgagaggccgaggcgggtggtcacaaggtcaggagatcaagaccatcctagctaatatggtgaaaccctgtctctagtaaaaatacaaaaaattagccgggcgtggtggtgggcacctgtagtcccagctactcgggaggctgaggcaggagaatggcgtgaacctgggaggtggagcttgcagcgtccgagatcgcgccactgcactccagcctgggggacagagtgagactccgtctcaaaaaaaaaaaaacaaaaaacagaaaaccataaaatttaccgtgtaaccattttaaatgtacaattcagtggcattaaatacattcttaatgttgtgcaaccatcactaccattcatctccagacctcttttcatcttgtaaaactaaaactccatacccataaacagtaactccccattccttcctctccctatcccctggcagccaccattttactttctgtctcttggatatcagctactccaggaacctcatataagtggattgtacagtatttgcttatttaacttagcgtatggtcctcaaggttcgtcatgttgcaggatatcagaattttctttctttttaatgctgaataatattccattgtatgtacgtaacacattttgtttatccattcctctgtcaatggtcatatggatttcttccacattttagctattgtgggtaatgctgtcatgaacaaggctgtacagatatctcttcaagaccctgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaattgaatatattcttaactattcttaaatcttggaagtccttacattttgtttttatctcttcttaggccagtactaaagtggaagtggacatggagaaagcagaaagcctgcaagtgatgagaggagacttccttgcttctttggagaatgatatcaaaccagtgagtatgcccattgagtgatatataggccaaaaagtaatgataataataactcaggcgaaacgtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcattcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcgtgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattgcacactccttatgagaatctaatgcctgatgatctgtcactgtctcccatcacccccagatgggaccatatagttgcaggaaaacaagctcagggctcccactgatgctacattatggtgagttgtataattagttcattatatattacaatgtaataataatagaaataaagtgcacaataaatgtaatgtgcttgggctgggcatggtggctcgtgtctgtaatcctagcactttgggaggctgaggcgggcggatcacgaggtcaggagttcgagaccagcctgaccaacatggtgaaaccccatctctactaaaaatacaaaaattagctggatgtagtggtacgtgcctgtaatcccagctactcacgaggctgaggcaggagaatcgcttgaacccaggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagttttttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctcccgggttcaagcaattatcctgcctcagcctcccgagtagctgggattacaggtgcttgccaccatgcttggccgatttttgtatttttagtagagacggggtttcaccatgttggctaggctggtctcgaactcctgacctcaggtgatctgcctgcctcggctttccaaagtactgggatctcagcatctgtttgtttttaaaccttccctagtctgtgcttatgtgttttgcttgtttgttttttgtttgtttgtttgtttgtttgttttttgagatggagtctccctctgtcacccaggcgggaatacagtggtgtgatctcggctcactgcaacttccacctccctggttcaagcagttctcctgcctcagcctttcaggtagctgggattacagtcacatgccaccatacccggcttatttttttgtatttttagtagagacagggtttcaccatgttggccagactggtctcaaactcctgacctcaggcaatccgcccgcctgggcctcccaaagtgctgggattacaggcgtgagccactgcgcctggcctgtgtggtttttaaattaactttttctagtctactaaggtttactcagacctttagcagttgttcttggatactgactaggcccaaagtcctcttctcatcaatgtattggcaaatacactcacttgcgatgtgatatgagaccctgaggtttacctcccaaacagcaggatgtctgttttgagagtttcctggccaagtggtggaaagtaccatggaaatggagtcttccttgcttcttacttaacttgagtttggaccatagagaagtcattcttgtgtggacctcagtttactcacctgtacagtataggatggactagatgatctaatgatcaggggattggcaaacttgttcttagggcaccaattagtaaatattttaggttttgcaggccacctggctatgtcacagctgctcagctcggccctggtaggatgaaagcagccatagacaataagtaaacaaatgagtgtggctgtgttccaataaaactttatttacaaaaacaggctgtggccggccatagtttgttcaccccatttttgagctcttgacattctttagtctgtgatttcgataattagtttaggaaaaaagctttgactttcataaataatgcttctggaaatctagtaaaacctttaaattttggccaggcatggtggctcacacctgtaatcccagcactttgggaggccgaggcgggtggattgcctgagctcgagagttggagaccagcctggccaacatggcgaaacctcgtctctactaaaaatacaaaaaattagccgggcgtggtggtaggcgcctgtagtcccagctacttgggaggctgaggcaggagaatcgcttaaactcaggaggcggaggttgcagtgagccgatatcatgccactgcacttcagcctgggtgacagagtgagacttcatctcaaaaaaaaaaaaaaaacctttacattttatttttgctttttccctttatcaggaaagtaatgtagaaaatttagaaaacccagaacattaatattttggttcctctcattaggtaaccatctttgggtggacatgtgtacatacatacatacttttttttttttcttttgagcaaaaaagtacatactttttctttttttctcttctgtcacccaggctggagtgcagtggcgcgatctcggctcactgcaacctccacctcccgggttcaagcgattctcctgcctcagcctcctgagtagctgggactacaggtgctcgctgccacacccagctaattttttgtattttttagtagagatggagtttcaccgtgttgcccaggctggtgtcgaactcctgagctcaggcgatccgcccgcctcagcttcccaaagtgttgggattataggcgtgagccactgcacctggcacatgtatatgtatgtattttttacaaaattggatgaagtataatttatttgctaaatattttcacttatgccatgatatcttatttaatctttaatttgtctatgaaaatacctgctctgctaggggacttctagttgaaaactcattaatttaaaaaattaattttgaattcagccacctattcttttttctaattgtttcttgtagcttttgctttgattggagtaactttattctaggaataaagttgtgtcatctgcaaacatgaatcatgtacacatctgattttcttatatttatgtctcctttttctcttcaaattacattgcctttaccattgatgggaacctgggtaataaagaaaaaagaaaaaaattgcattccctaccacctcctccaaaacaatgtcaaatgttagttataatgataggcatcttagtatgctatcccaatttaatggaactgttgcagatatttaatggttaactgttggtttgagacctttaatgtgttgagtatattcacctatttcaattttttttctgtttaagtttttttttttaaaatcagatatggctattatattttgttaaatgacatcttagcatcttttaagatgatcatatagttttcctcctgcatgctacatattaattacagtagtgtatattcatagaattatattagtagatcttatattgattcacccttacattcttgcagtgaacctctcttgatcatattattttttcatgtactgtttgactttatttatttagttttgagacagagtttcgctcttgttgcccagggtggagtgcagtggcgcgatctcagctcaccacaacctccgcttcccaggttcaagcgattctcctgtctcagcctcctgagtggctgggattacaggcgcccgccactacgcctggctaatttttggtattttcagtagagacagggtttcaccatgttggccaggctggtcttgaactcctgacctcaggtaatccgccggcctcggcctcccatggtgccgggattacaggtgtgagccatcgcgcccggcccgtttgacttttaaataggtattttaattttttagtttatacgtgtacagtgcataatgtatttaagattcatctgtgttgttgtatcagtagtttctttattgctgagtagcagtcctttatatgagtgtatcacagtgcatttatctgttcaatagttgaatatttcaattatttctagtttgtggcagctatgaataaagctgccgtaaacatttccataatgttttttgtctgaacacaattcttgtttctcttgagtaaatacctaggagtatgatttctgggttgtatgtttataagaaactgccaaaactgttttccaaagtagctgtaccattttgcattcttacctgcaaatgtatgaagagttccggttgctctgtatcctccctagcacttgatattttcagggttttgttttgttttttttttttttttttttttgagatggagtctggctctgtcacccaggctggagtgcagtggcgcgatctcggctcactgcaagctccgcctcccgggttcatgccattctcctgcctcagcctcccgtgtagctgggactacaggcgtctaccaccacgcccggctaatttttttgtatatttagtagagacggggtttcaccatgttagcgaggatggtctcgatatcctgacctcgtgatccgcccgcctcggcctcccaaagtgctgggattacagacgtgagccactgcgcctggcctcaagttttttttttttttttttggccaccttaataagtatatggtggtagcttcttctggttttaatttccttgtccctaatgactaatggttctgagcctctttttatgtgcatcttttgatttgccatctgtatatcattgtttatggaaaaatactaaaatcttttttttttttttttgagacagagtcttgctctgttgcccaggctggagagcagtggcacagtcaccactcactgcagccgccaccttctgggttcaagccatcctcccacctctcggcctcccaagtaactgggattgcaagtgcgcaccaccacacctggctagttttttttttttttttaatagagatggggttttgatatgttgcccagactgatttcgaatcctgggctcaagcgatctgcctgcctcggcctcccaaagtgctgagattacaggcatgagccaccatgcctggccaagataccaaaatctttatttaagatgtttaattgggttgctttctttattgttattcttcttttattttattttatttatttatttatttatttgagacggagtctcgctgtgtcgccaggctggagtgcagtggcgcgatcttgactcactgcaagctccccctcccgggttcacaccattctcctgcctcagcctcccaagtagctgggactacaggcacccgcccccacgcccagctaattttttgtatttttagtagagacggggtttcaccatgttagccaggatggtcttgatctcctgaccttgtgatcctcctgcctcggcctcccaaagtgctgggattacaggcgtgagccaccacaccaggcctcttttatttttttagacagagtctcgttctttcacccacgctggagtgcagtggcatgatcttggctcactgcagcctgtcattcccctcgactccaggttcaaggtgatcctcccaccacctcagcctccgaagtagttaggaccacagatgcatgccaccatgtgtggctaatttttgtatttttaatagagatggggtttcgctatgttgcccaggctggtcttgaactcctgagctcaagcaatctgcctaccttggcctcccaaagtgctgggattacaggcatgagccaccatgcctggccaatttcttactgttgggtagtaagagttctttatatattttggatataagtgctttgttaggctgtgtgatgttcatacattttccccatctgtgccttgtgtttcattgtcttagcggtgtctttttcccagagcataagttttaaattttgatgaagtctgattaaccacattttttcttttacacatttggtgttcatctaacagctctacctaacccagaccttgccagactttttctgtaaaaggtcagatagtaaatatttcagccttgctgtccctgttgcagctctgccattgtagcaatgaaagcagtcatagacaatatgtaaatgaatgataatggctgttccaataaaactttatgaacactgcagtttgaatttcacataatttacaaattatcaattatattgtttcgattattagaaaaacaggtagtggattggccatggtttgctgattcctggcctgacaaacccaagttcacaaagattttcctctttgattttgttgtggtcgttgttccacaccttcttttttcactgtttccttaaggtagagtgtacatatttataagggtacatgtaatattttgatagattgatacagtgtgtaatgatcaaatcaggttaattagggtatccatcatctcagatgtttatccttttttttgtattgggaagataacaaatgttctagctattttaaaatatacactaagttattgttgactctagtcaccctactgtgcaaataaaaactgaaacgtattccttctatcttgctgagtttttatgcccatgaatcaacttgtcttcatccctacctgcttcccagcccccggtaaccatcattctactgcctatctccatgaaatcaacttcttaatctctcatatatgaatgagaatatgtgatacttgtctttctgcccttggcctatttcacttaacataatgtcctccagttctatccatgttgctgcaaacagattttattttccaaaccttaagctttatagatgacttcactttttaaatggctgaataatatcctcttgtgcatgtatacctcattttctttgatttttctttctttctttttaaatagagatgagttctcactatactgcccaggctggtcttgaatttttttgctcaagcaatcctcctgccttggcctcccaaagtgctgggattccaggctaaaccactgtgctcctttatgcgtttttttgtttttgtttttgtttttagagacaaaatcttgctctgttgcccaggctggagtgcagtggtgcgatcttggctcactgaagcctccacctcccaggttgaaattattctcgtgcctcagcctcccaagtagctgggattacaggcacccaccaccacgcccagctaatttttgtatttttagtagagatgaggtttcaccatgttggccaggctggtctcgaactcctgacctcaggtgattcgtctgccttggcctcccaaagtgatgggactacaggcatgagccactgcgcccagcccctttgtgcacttttaaaaacatatcttagaatttgtgatacatgttttattttcattttcatttggttcacaatattgtaaaatttctactatgacttactctttgacccatgatttgttttaaaacgtattgtttaattttcaaacatttagggatttcccagacatctttgttgttggtttctaatttaattccattatggttagggaacatactcgttatgatgaattaaaaaaaaatgtagaggtttgtatatggcctgaaacattgtttgtttaggtcaatgttcagtttgtaataggaaagatgtgttctgctgccgttaggtaaagtgtttcataaataataattaggtcaagttggttgatcgtgttaaggtcttccctatccttgctgatttcctgtctgcttgttctagtgattactgagaaaggagtgttgaagtctgcaatgattgttatgggtttgttctctttctccttaaaattctgtctgtttatgcttcctgtattttgaggcactgttattagatgcagaaacatttacagttttgtcctcttgattatttgacccctttatcattctgaaataacctttatttctggtaataatcattatattaaaaaccattatttggccagacatggtggctcatgcctgtaatcccagcactttgggaggccgaggcgggtggatcacctgaggtcaggagttcgagtccagactggacaacatggcgaaaccccatctctactaaaaagagaaaaatagcctagtgtggtggcacacgtctgtagtcccagctactcagaaggttaagtcaagataatcacttgaatccgggagttggatattgcagtgagccgagatcacgccactgcaccccagcctgggaagcagagcaagactccatctcaaaagaaaaaaaaaaaaacaaaacaaaacaggcctggtgcagtggctcatgcctgtaaacccagcactttggaaggccgaggcaggtgaatcacctgaggtcgggagttcgagaccagcctggctaagatggtgaaaccccgtctctactaaaaatacaaaaattagccaggcacggtggcagctgcctgtaatcccaagtacttgggaggctgaggccagagaattgcttgaagctgggaggcagaggctgcagtaagccaagatcatgccattgcactctagcctgggtaacagagcaagactccatctcggggaaaaaaaaaaaaattacttaatattaatataaaattagtgttttatattagtagtataatactgtttttgactagtgttaaaatgacatatctttctctacccttttgcttttaatctagatatcatgatattcatttattttttaatttgtaaaaatagagatggggttttgccatgttgcccaggctggtcttgaattcctgggctcaagccacctgcccacctcaacctcccaaaacgctgggattataggcgtgagccaccatacttggccatatcattatattttcaaatggtttcttgttttttcgtttttcttttaaatgtaatctgacagcgtcttttaattaatgtgttttggaccatttacatttaatatgattgatgatgattggatttaggtttcctttttattatttgttttctggttatttcttttttggggggtttcttctgtttcttttttctgcctatttttggattaactgaatattttttagtgttatgttttattaattggcttttggttatatctgtgctgtgtttttgctgtaggaattacaaaatatatacctaacctacctacttagagttagcattttacctctaaataaaatgtaaaagtattgcaaacatataggtttctttattctagcccccccttataattgtatatatgtgtgtgtgtatgtgtgtatatatctatatacactttcaatgtatgtagatatgtatctatactttcagtgtatattatatctacatgcatacattgtgtatgtatgtagatgtatatctacatacattgaaagatatatatctacatacatatacaatgcatgtatgatacctttggctactacatccttcttaaatttcctgttgccacttatgacctgatttccttgaccagttattcctccttcaaacatccctcttacatgtgatagtcctcagcatttagtttccccaactttcccctaattatcagttgactcaattaccaccaaaatatcaatgacttttttgagacagagtctcactctgtcaccaggctggagtgcagtggcacgatcttggctcagtgcaacctctgcctcctgagtccaagtgattctcctccctcagcctcccgagtagctgggaatacaggtgtgtgccaacacacccagctaatttttgtatttttagtagagacggggtttcaccatgttggccaggatggtttcaatctcttgaccttgtgatcagcctgcctcaacctcccaaagtgctgggattacaggcatgagccaccgcgcccggccaaaatatcaatgacttctagatccattttcctacctagacctcttttctaaactccagatatatatttccaactgcctgtgctgtccgccataaactccacattgtaggaaatagaaaggagttataaaagtttaggttcaaagcaaaatttaaaaactcataaatgagacaaaattttgtgatgataaaggctatggtccacaatgaagatatgaaagtaatgaacctttctataaaatgtataggtgatagagctggtccccaactttaagcctttcagcgattcaagtaactacagaacatcgttaaagtactgagagaaatgtcaatccagaattctatatccagcaaaaatacccttcaacaattaaggcaaaaagaaaaagaagaaagacattttggatgaagaaaatctaagagaatgtgttggcggaagttctgctctaaaataaaagtaaaagaaggtctttaggccaaaggaaaattataccagtggtaatactagaacttcagagataaagagcagcagaaatggtatctgggaaaatttaaaaatgcaaacggttgtttctcctcttaagctctttaaaatatgtatagtggttgaaagcaaaagttaaaacactgctgagactttcaatgtatgtagatatacgtatatatatctacatatatatacatatatatgtatatacatgtagaggtaataatggtagctattttatggagctgatctgaggataaaatgaaagaatgcattttaaagtgcttagcacaatgtctggcaaatagaaagcactctataggccaggcatggtggctcacgcctgtaatcccagcactttgggaggcctaggcaggtggatcacttgaggtcaggtatttgagaccagcctggccaacatggtgagaccccgtctctactaaaaatataaaaattagccgggtgtggtggtgggctcctgtaatcccagctacttgaagtgaggcaggcgagtggcttgaacctgggaggtggaggttgcagggagccaagattgcaccactgcactccagcctggtcgacagagcaagactccagctcaaaaaaaaaaaaaaaaaaaaaaaaggtggggggacaatgttactcttcttccttctagaaacatacattttatagaagttgttttttgaagtctagaagtctgaaaacgcaggagtcaactctgaaaaatctacagtggtttctggggttcaatcttggcatgactttacccctgcatctctgccctcagcaggtagttttgtttatgggtgtcattggttgaacagataattgttttagttgctacaataaataaaacatgatctgtgctctaaaggagtcaacagatgagccaggggggcatgagtaattgcctgtaatataattgtgctcacgctgtcatggaggaccgtacaaagtgtcagaagcacagtgccaggaggcacagcaaagggtagtagaggtgacatttgagcccagccttgaaaactgtctaggatttctcagcatttcagcaaagtaaggcaatttctgtctaaaatatataggcaaagtttttataaaaatacgagaaattaattaaataacagattatgaccacaatgcagatttaaaaactaaggtatgatgagtgccgttgaccggttcatccagacagttcagagaacagaacatccatgtagatccttcttgtattacagaatacaaaggagcggaaaattttgcctcagtaactgccaggtcattctaattaaagtacctatacattgtaatataattcctccattaaggtaacagccaatcaggtggtacagagtctgtgccattcagtcaagaaattcactcccttaacctagactgtgctggaagttcattgacaaattttgttctttggttctccatttttcttcagaattcatgcagaccacttgacttccttagcattttcttttgtgggcgtatattaatgtctttggttaagcttcagcttccgtttgcatcaatcctgttgtaatcgtgcctcctgaggcatctttttgcttcccttgcatcagtttccaaaatcctactttctgcttggtaaggggagtatccattttctttaaagcagtggttttcaaacttgcctgcacatcagaattatttggggagaaggataaaaatacagattactgagcttcacctgggattctgtagatttgagttgcatttgggattactttaaacaatttaccagatgatttttgtggcacctccacttcagttttaggaaggactgtttcgaggcagcttttcaaactttaatgaccatagaaatcacctgaagattgtgagaaactgcagatcctgatttagtaggcctgggtttaggcctgaggttctgaatttctctgaaatgtgataatagcaaatcccttgttgagtagcaaggttgttttttgtttttttcttttttttccaatatcttcatgacattcaatgagtagcaaagtttgaagataacttctggaatttcatctaatgtgtattaatttttactcatctggatcttaggggaaataacctatcagattatagggaagtgtttctcaaagtatggttccccaaacagcacaacctgggaattgttagaaatgcaagttctgggccgggcactgtggctcatgcctgtaatcccagcactttgggaggctgaagcgggtggatcacctgaggtgaggagtttgagaccagcctggctaacatggtgagaccccgtctctactaaaaatacaaaaaaaattagctgggcatggtggtggtactttttaaaatttttttagagacagaatatccctgtgttgcccaggctggtctgtaaatcctgacctcaagcaatcctcctgcctcagcctcttaagtagctaggtacaagccaccatgcccagctatattgacttgtttttgagacggagtctctgttgcctaggctggagggcagtggtgcgatcttggctcactgcgacctccgcctcccgggttcacgcgattctcctgcctcagcctcctgagtagctgggaccacaggcatgcaccaccatgcctggctaatttttgtattttagtagagatagagtttcaccatgttggccagactggtcttgaactcctgacctcaaatgatccacccgccttcgcctcccaaagtgctgagactacaggtgtgggccaccacgcctgaccatatatttacctttatgtgaatttaaaatgtgtgggcgtgaccaagtcgtctgccggctgttatataaaggagactttatcatcaacatgctcatcatcagtcacaaactgcctatttggaactcccttcagttctcagaggatggaaacattctttaagcggccttgtagaaatcctattccatgttaacatgccaaccaattttactttcccagagccacagaatgatatctcattgtatgcctcaattcaatcacctttccattttcaaggaccgatttcaattcctgattggctacttgatctgactgcttcctgctaatcttgttgcctattgtctatattccatttctcattgaattaaccttgatcaaatctgagaactctgcttagtaatgactccaggtatactatacccacttttgtagcttattcaacaccctcttcaatcctggttccacttcctgtgactgaaatgattacctgtgaaatattatttaacttttggacgatgatgtgtttctaacctgtgaccatttcacatagccactcaaatatggtaaaggtatggtaaagatgatgaaacagttacttggcatcattttgtaagtaatgagtttttagtgcgctttggaccttgagaccacttcataagctttagattttgagaatttcacagcataaagctcatcgctgatgcagtaatgaaggaaatgttctacaagttaatagatgagtgagaggagagggcattcatattagatttatttacttactgaactcagagccttgggttactacttgacccccactgttatctagtttaagggtccttttattttttgttttttcgaggtggagtttcactcttgttccccaggctagagtgcaatggcccggtctctgctcactgcaatctctgcctcccagattctcctgtctcagcctcccaagtagctgggattataggtacccaccaccacgccctgctagtttttgtatttttagtagagacagggtttcaccatattggtcaggctggtctcgaactcctgacctcaggcagtctgcccacctcagcctcccaaagtgctgggattacaggcatgagccactgctcctggccttaagtgttcttttctactttagcacatacacctagttgctgtcttttttgctttttataaatacagaaaagagaataatgttttaaaatcaaggaaaggcctaaggcacctgtgagggttttttgtttttgtttttgtttcagtgaaatgaagggaaatggtcaccagcaagaactgtggcaatgttatccaaggtgacaactgtctgtaccacccaggggctcagagcccttctgaagtttcctagatgttccgaaagtctccactgtgactcatgttacaggctggtctccgtggtagcactcaacgtttaaaaattagtcttcattgccaggcgtggtggctcacgcctgtaatcccagcactttgggaggctgaggtgggtggatcccgatgtcaggagatggagatcatcctggctaacacggtgaaaccccatctctactaaaaatacagaaaattagccggcagtggtggggggcgcctgtagtcccagctactctggaggctgaggcaggagaatggcgtgaacccgggaggcggagcttgcagtgagccgagatcatgccactgcactccagcctgggcgacagagggagactccgtctcaaaaaaaaaaaaaaatagtcttcatttctccttcccaacaagcgtttctctttctcttcagtgggaaaaagtaatttcattttttacttgctcattgttttattcattcactcaatcaacagaccatctatcctgtattgtatgccaagaactgtgctttgttctgggaatgaaaaaagaataagatatgttttcctctggcacttatggagcttataaaccagtgacagaggaaggtgcataaacaaatcaacaaagaattaactttactattcttattaatttctaatacaataaatttgactatttgtatcatttgagtttcatgaatataatcatattctacacttacaaaatgaaatagacataagaaagaactggtgatgtaagaaattcacagaaatgtgtaaaatatttcaagaattaacactcagtagatatttgcattgtcaaagaagcttatacatgcagatgaacctctagttgttttagttgcttgtaaaatgtatagaggtatgtgtatttcctctttaagcaggggtaacttggggtgggggatgggtgggttcatcttatctattcttcaggtcatgttctcaagaaggagctactgaatgggaagactgaaacaatttcttttctttgcacagttggtattgataaatctcaggtgtatccaaaataaaatctctggcaggctgtgatatttgtgggtctgtctcttgtgactttaggttcctcttggcagcagacataaggcagttgcacatcaggcccttgcctgaaacagctcctgatgccaagaactggtgaattactactttggtttcaatggatggtcagaaaggatcatcaggataaactttgtggattttctctcactaaccacgctctcctttcaacattgaaattctagactttagacagaagtattgaactgggttacagggaggggatgtgagaggccccctgccattgaggataagtggacatgtctgaattggcctgctacctaaaattaataatctcaatcacttggatggtggtgtccataattttctccactgtttgtgtggcatataataagtaatggttgcacctagcaattcatttacaaatcttacttgattttgaagccatagaacacctcaactgttagcttgaatgactggagtttagtttttatttctcagaacaaaacagtttgaagcctaattaacatcctcggaaggaacttaacactaaaactcctaacagcttcagttttctgaccttgaagaaagggaaaatgaagagaccatggtgccacttccgaagcaaagcctgaagttctgtgctttagaggtggtgttgccatcctatgattgcaggagtctggccttggcttggtggaggagcctgtggataaggcgaaggaaggtctgttttcattgggggtagaggagggtaaggagttgaaatgggaaggatctcttttttcttgctgtctaaaacttgtcttttcagacacatatcaagcctttccctctctgagctactgaagtcctgggcagaggttttctgtcttacaatacagacttttaccttaggcaatacctgacagagcctttaaataagtaaataaattgctttaataaattgatttaatacattgatttattaattaataaattgatttaatacattgatttattaattaataaatttatttaataaattgatttattaattaactaattttgagagagagtcttgctctgtcaccaggctggagtgcagtggcgtgatctcggctcactgcaacctccgcctcccgggttcaaggcattctcctgcctcagcctcctgagtagctgggattacaggcgcccaccaccacacccagctaatttttgtatttttagtagagatggggtttcaccatgttggccaggatggtctcgatctcctgacctcgtgatctgcctgccttggcctcccaaagtgctgggattacaagtgtgagccaccccacccggccagaacctttaaatttaaaattgtacagtgtacttcctgccaagaagcgtaggaggaagaaggaagtaatgtttttccagttttcggttaagaacttgctttgtattaaaatagtccttcaagtctacagccataccaccctgaacgcacccaatctcgtctaaaatagtccttcaaatatgtatctcttatagccttcagttatcccaacaaaattatctaaagatttgtttatctatttattattattttttagagacagggtcttgctctgttgcccaggctagagtgcagtagcatgctcatagctcattgcaacctcaaactgctgggctcaagggatcctcccaccttagcctcctgactagccaggactacaggcgtgtgccaccacatgtggctaattattttttctggagatggggtcttgctgtgttgtcctgcctggtctcaaactcctggcctcaagtgatcctcttcccccaggatcccaaggtgctggagttataggcatgagccacccaccatgccaagtcatcatgtaaagatttacagaaagttttgtgtaaacattgtcttttttttttttttgaagcagagtcttgccctgtcgcgcaggctggagtgcagtggtgtgatctcggctcactgcaacctccacctcccaggttcaagtgattctcctgcctgacactcctgggtagctgggattacaggcatgcaccaccatgcctggctaatctttgtatttttagtagagatggggtttcattgtgttggtcaggccggtctcaaactcctgacctcgtgatccatctgccttggcctctgaaagtgctaggattacaggcatgagcaaccgcgcccggcccattcagccttttttttactcgtagaagggcttcagtggaacaagagtctactagagatactagaaagggtactcaattgataactgacgttgagatttttttctagtattcatggccctcaggcttagggtttgaagtcagaggcagggctgtaggctaatggaggggagtaggctttcatggatgatgcccagggaggagccagattatctgtaccaaaccttttttgtttttttgagacagagtcttgctctgtcgcccaggctggagtgcaccggtgtgatctcggctcactgcaacctccacctcccaggttcaagcagttcacctccctcctgcccaccaccacactcagccaatttttaatttttaaaaaattttttagtagagacagggtttcatcatgttgctcaggctggtctcaaactcctgacctcaagtgatctgcccatcttggcctctcaaagtactgggattacagatatgagccactgtgcctggcctctttttgaaaatagtcttactctgtcacccaggctggagtgcagtggaatgatctcggctcactgcaacctccgcctcctggttcaagctattcttgtgcctcagactcccaggtagctgggattacaggtgtgtgccaccacactcggctaatttttgtatttttaggagagatggggtttcaccacgttggctaggctgttcttgaactcctggcctcaacccgccttggcatcctaaagtgctgggattacaggcatgggccaccgtgtccagccaacaaagctttttttcagtgagtgattccagcccttgatgcataggagggtggggtccataggagtgtagccttaactgatgaattaaatctctgggtgatgtgagatatgtgccaggttcttggcttatgtctccctctagtactttaggaacttcccaactagatggaggcagtaaaaatgggccctgccaggatgtacctataacagagacgttcaaccatacccttgtgctgtctgcctttaatcacgaagattatgagctaagattcgtggatgcatttttattttttaaccaacatgtagcaatgatcactcagataggcatcttaaatccattagtttgggttggatttaagaccgttgtcattcctatgaaagggaagatagcccagattgctattgagaaggctttgtcagatgcattccagaaactgttgattgtggttctaggtaaaactttcttaatcgtcgttgaagtacttcagtttcagtgagcaaataaactcattttgaaaagttaattggataaaaatatcgatatctaaaacactccctaggatgctttcatttgctaagttctttcacagcgacaggctcaaatttgttctttgtgacatttgtagaaaaaatgacagcaaatattgtccctagtttatagctataaaaggacttgcctcaggtcacacagaaaatgtttgaggcaggtcttctttaattgcatgcctatcgtacagaatagtgattataagccctggacacatggatttgagtcctaactctgtctcttagatttttgtatgcagttttaggtcttatggccagagagatttgaagatatttaatatctctaagctgcaatctttatctgcaaactggggttagtaatccaatcaaccttattgctgatattgtaagaaaaaatgagatgacaagtgtaaaaactcagaactatacttacaaggtaagcagacaaaatatgctattgttgtgattgttttctctctgaataaataaactctgctgaagaatttattagattatgtttctcgaatcgagaattcagttccagctctcatttctggcactgacatattggccaaatatgattcttatacaataatcagctgctttgctgtgagccttggaagtggtcatgctgttgaatggcactgcttgtatttcctattcagttctacagtggcacaaatgtcatagcctgtgcccaaaggaaacctggtgtttaacgagtccctgaacagagttgcctttctgcttcacaaccctgaaggcttagagactgagattgtaattaagttactacagacctttatttgcttgtaagaggtggccctgattgctctcagctttccaacctgggcagcccttctagtgaaagtcttacttccttggtcatcaactgtcaagtctgagtaatgacatttaataaccaagctaaatgtgtgggttgtctacccctccctagtatgcaaaggtatcccttgcacacactcacttcttagaccaaaagccttatagttctagtttgccttgaaggaaattgtattgtctatagagtatgtgggccattttctgcccgtaaaatgttcaaatgttttctctctctaaagctttgttcattgtatctggtggaattttggttctcagggagtagacacctagccatgcttctaatgtgaagtgtctactagcccagtggtctctattttggatttgaacttacttcgaccccccacctggtgccttaccttttaatcatgttatgattgaacatttttatttccacattttttatttcttacgttattattccttagttcctatctgtaagatcataaagtcctttgaaccaaacacagttgatatttcatacatatgttaaaaactgagctgtgagaccagacatgatgactcacgcttgaaatctcagcatttcgggaggccaagacagaaggatcacttcaagccaggagttcgagaccagcctggaaaacaaagcgggaccatgtctctaaaaaagagaattagacgggcacagtgatatagtgcctgctactctggaggctgaagcaggaggatgacttgagcccaggaattccaggctacagtgagctatgatagtgccactgtactccagcctgggtgacagagtgagaccctgtctaaaagaaaaaagaaaaacaaaaatcgaagtgtatgatgaagagatgaggaaactttcaggaaaatgcttatttcctgcttttagaaactaaaagaatgtctcattgtgggttgctaccattatatgcaggaagttttggaatgaaaaagattctgaattcatccttgctaactttatttcagaaagtggtaaaatagctatggagtacagacccagtgaagagattgtagatgtcagatgggaagaagaactacacggtttaatataagtatgtggagataaaaactcaaaggtaacagggccgggcacagtggctcacacctgtaatgccagtgctttgggaggctgaggcgggtggatcacctgaggtcaggagttcaagatcagactgaccaacatggagaaatggtggcacatgcctgtaatcccagctactcgggaggctgaggcaggagaatcgcttggacccgggaagcggaggttccggtaagccaagatcacaccattgcactccagcctgggcaacaagagtgaaactctatctcaaaaaacaaacaggccaggcgctgtggctcacacctgtaatcccagcactttgggaggccgaggtgggtggatcatgaggtcaggagttcaagaccagcctggccaatatggtgaaaccctgtctctactaaaaatacaaaaattggctgggtgtggtggtgggcacctgtaatcccagctacttgggaaactgaggcatgaaaaccactagaacccaggaggcggaggttgcagtgagccgagatcatgccactgcattccagcctgggtgacagagcaagacactctctcgaggaaaaaaaaaaaaagaaaagaaaaacaactcaagggtttgataacattgccagtataaccataattcaaaacaagcagcagaatttggaggataatttgtttaattctcaggaaaatgtgaaactctgaaactgctttttgagtgcagggtatttccggggcttttcctaaagtcttaacccttggctctgaccccttatttgaagtttggagagcagaaccgaggattgtattactacagttgtggacacaggagaggggttagtctccccccgctccaggagtaagggatgctgggctgctcgaacacaggccttgttagaactcccttcaaacaggatcccagagatgtggggagaaggtaactggccttaagaatgattgcgctacagcttttgaaaactataatgcctttcaaatatggcttattgcttggatctcaatatctcccacgtatcttgggtggaatattttgctgaagatctttctgtcaatcatttacaatcatgtgctgcaaaatgaagtttgcgtcaacagtagaccacatatatgatggtggttccgtaagcgtataatggagctatccctatataggtataccatttttatctttttttttttttttttttttttttttttttgagatggagtctcactctgttgtccaggctggagtgcggtggtatgatcccagctcattgcaacctccacctcccaggttcaagtgattctcctacctcagcctcctgagtagctgggattatagacacgcgtcaccacactcagctaatttttgtatttttagtagagatggggtttcatcatgttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaatcacctagtgacccatttctcaagctcctcacgtggcaagcaatgcatgactgcatatgaaagctcttaaatagggattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataacaatagctccatccctaaatgaggtgaatcttggaatctcttccattttattttattttatttttttgagatggagtttctctcttgttgcccaggctgaagtgcaatgttgtgatctcggctcactgcaacctctgcctcccaggttcaagcgattctcctgctttggcctcctgagtagctgggattgcaggtatgcaccatcacacctggctaattttgtatttttagtagagacggagtttcaccatgttggttaggctggtctcgaacttctgacctcagtgatccccccacctcggcctcccaaagttctgggattatgggtgtgagccaccacacccggccccccttcaattttaaagccatcactatgcaccctatgtctatgccaggcactaaaataagatgaagcaccttcttggagtttacatgctggtaattatgccagacagtaataaaataggtaagaacggctgtgggggaagtcagctgggttctagttacagtcgcatttcaggaaatgatttaacatgctgactttaacaacctaagcctcttctccatgtgtgcacacagggtagatctctgaacacaggtgaccctagaagtgctgtaacttctaggggaatggctgtgttgagtcaaggcaggatgacagttcagcctcctcccaggctagtgcaaagggctcttcactcggattaaaaccttctctcccagaccgaattgccaactcccaacacccctcctacagaaaatgtggagtcctcgcttattccctggcagcccctacctaatagggtggtgaattaattatcaaacatgcgacagtttagcgaaaatggcaacactttggaataagtgactgtaatgtgcatcctggcgcccattttgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccaccccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtgacataaataaaggtgtcataaagacagggcggggctcacgcttagaaggggcacgagcgtctcggagctgccagaatgtcttctgctcagtgcccggcactagtgtgtgtcatgtcccggctgcgtttctggggcccatggcccctccttatgtggcaactattgtggctactagttaaggaggctcagcctctggagtgggtcaaggacccgctccagctcacctctaatcccctggggccgcctgactcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaagactccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactagacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcagtgatgatgctctaagtggttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttagcatatgtaggagagttggctgttcacatgattattcagtcctttagttttgtccagaactcatttttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggcgggcggatcatgaggtcaggagatcaagaccatcctggctaacatggtgaaaccccatctctactaaaaatacagaaaaaaattagccaggcatggtggtgggtgcctggagtcccagctactcgggaggctgaggcaggagaatggcatgaacctgggaggcagagcttgcagtgagccgagattgcaccactgcactccagcctgggcgacagagcaagactccatctcaaaaaaaaaaatgataggagggaagaaagagaataggcataaaaagggaggtatatataattaagtactaaaagataatgcagaccattggtgctagaatttgccagaatctgtgatccttgaggtgtggagatgctacatgggtaagctaaaactttacttgggtcttaaagagtagccataatttgttaaataggagaaaaatgggagtacagtctaggcaaacgcatggctacaggtatggttggaatttagtagaccaatgtggctacaaagaattaggtgagggagcaatgaagatacgattctgtaaaaccttgattatcagctacaggagtttgaaagttacacaatgaggtatggaaagccattgaaagtttccaagcaagagagattacatgatcaaaacaggaagattattttattttgttttttgcattatgtgcaagtgtagacatgcagaggattgttttagaatccatatgtaaagtgtccaaaaggaaaagcttaattcagggagacaaaatagaaaggtctagcaaaatctaggagtgaggtgtgaaggggccaaatcagatcagttgtaataggagtggaaagaaaaagcctaggatgtttcaacagagggcactgggccaaagctttggtgttacctggcatagggtttctttcttctcatttgttgataatgataagcttttgcccatatttctgtggaattatttaccattttggtactgatttgtagaagtctgtttagacacataagtgcttttagataaaatacttacattcaaagtaattaactggcatcatctgtccaagagatgggatggataagaagttaagcttccaggagatgcctcatcatttgtgccggtgaccccgcataatttcttgatgaattgtgcaaactgggaagctgatagctctggaaatgagaaagcaggtgttattttctgtttctgaatatccccaacaagattgcaatgattcttttacttatcgtgttcattgttttcctacctattcaaggatataaactgtgtttcttcacagaaatttccaaggaaactatatttcttacattgatggaaatgtatggaaagcatacagttggaccgagaaactgtgagtatattctctccaaatatgacaaaaagctaactgcattgtaagatccttcttggtccagaattttgaggtcggtacctctgaggaaagatatttctcctccacgccccaaatcaaccactgttgattgcaattgtatggttattttaaaattaaatttggtaggctctctttaaaataagaggcaatttaaatttattttttatcatacaaatagtacatggttatattcctttttgttctctttttttttttttttttttttttttcagagacagggtcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtattttttgtagagacagggtcttcctatgctgcttaggctggtcttgaactcctgggctcaagtgatcctcccaccttggcctcttaaagtgttcatattacaggcatgagccaccacccgcagcccatgattccatttttaatatataaaaatgcaataacagatataacaaaaactctccttgtgccctactccctcatccctgaagtaatgctactctgcatttagtatacatgcttccagacttttcctcatttacctacatacatatttacataaagcaaaatagatttgttttgtggttttaaaattttttcttcgcataaagggtaacatcttgcaacttgattctttcacttcatgatatgccttagatttctttccttcccagtactgagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctggaaatggaattcttggggtgaagactatgtagatataaaattttaattgccttcaaaaattttgtgccaacttactctattgtcagcagaatatgacagcattcatttcccaacaccttttcaccgctgggtattctccaactttttgctgaagttatggatgaataaaagggattccatctaaatgtgaatttttctgattactcatgaatttaatttagtatctttatatgtttattgaacatttgtgtttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattattccaatgtatatagacaagccacgatgagttctaaattaaaaataaacatatgctaggcgcggtggctcacgcctttaatcccagcaccttgggaggtaggcggatcacctgaggtcaggagtttgagaccagcctggccgatagggcgaaaccccatctctactaaaaatacaaaaagtagccaggcgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagggattctcctgcctcagcctcctgggtagctggaattacaggtgccctccatcacacccagctaatttttatatttttagtagagacagggtttcaccatgttggccaggctggtctcaaactcatgaccgtgggtgattcacccaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggcatgctagcaatgatcttttgtaacgatgtttacatgggtatctgcttcataattattaaactgaatattttggccaggtgaggtggctcatgtctgcagtcacagcactttgggaagcagacacaggaggatcacttgagccaggagtttgagaccagtctgggaacagagtgagaccctgtctcaaaaattaaattaaattaaatataaacaacatttatgttatgtgcactttatgcacattatagttctccagtttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataacagaatttggtgggaagaaacccactcttcaaggggtgtgcttgagtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtaaaatgaataaggggttcaaattagataatctctcagatttctttgagcaataaaattctgcaattctgtaagtttgtatagggtctcagcccatctctagcactagctacctcctgtgcattttcagtttttaagttgtatagacaaaatacagacaaaaacatttcacatggtaagaaaatctgagcagtgactgacacccatatgaaccttgttttataagggttcacatatcattctttttctattcagtctacaaccaatagatccaatctaatttatggtctatttttaaatagcccattaagttaagaatgggttttgcatttttaaagggactgtgaaagaaaaagaaaagaaacaaagaaatatgcgagagatcatatgtggcccataaaacctaaaatatttactgtctgaccttcaccaaaaaaaatttcaaaaagttggtttagtaggatgaaaggaactaaagttaacttcagatggttgcctaaaggagaagaaaatggagaccacctgcattcatttgaacatcattaatccagaattttttggtaatttaatcggaattaaattaacatttaaatattaaaaatagctgaattatatcaatattatcatcaagaatattaagctaccaagagaatagactggtattaaggatttcatttcaggaattgttatattaaaacagatgtttaaaatgatggttaactggtagagctagaaatgtttacactaagaagcacatcagaaatgcccctaactcttcactaattacaaaataacgatcgccccagccctgttaccaagaaagggatccctgtatttctgtctgtttagagacaagaagatactatgttcattgctatgaatgcttgattcttaccctttgtccatagaggtgtgtatgtcattaatccttattaagctcattagtgatgctcttttgcaaacagattctctcaaatatagaaggcttaaggaaagtgggtgtaaagaccctcaggtggatgccaaagtgctacagagaccatgaaataataaaactacgtttcctttaaaatagttattttccttctactcactcccccctattcatttattttacaaatatttgagtttgctttatttccatgtgtcagttttaaacatggtgggcaatgcagatgagcaagacctagtccatgctttcagggacctgtttatgctcagaagaaatgggatacaaaataactacattaagaagaagaaatggatgtgggcactaggagggataaattgtttctcgaacatagaagaggaaaaaatgccttcaatttggacccaggaggatgttactagaacaatgccatttgaataggactttaaagggccattgtgtaacaccagacagacatcttggggaaaatactctaaacttgcaaaaggaaaatgggagggcaaaacacaggaaagtattcaaggaatgccatgagtacccgtagagtacaagaagggagagtaggaaaatggagccagatcttctagagctttgaatgccaagctgaggagccaacatggggaaccgtgttaccacagcagcgctgtaaggtagatctgcatcacagtcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactagagatggagacatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagtgcagtggtgcaatcttggctcactgcaaggtccgcctcctgggttcatgccattctcctgcctcagcctcctgagcagctaggactacaggcacgtgccactaggcccggctaattttttattttttttgtagagacagggtttcaccgtgttagccaggatggtctcgatatcctgacctcaggatctgccagcctcggcctccgaaagtgctggattacaggcctgagccaccgcacccggcccgactattttttttaatattagaaattgtgtatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggcagggttaggggctctggaatgttcaaatacaagtccaaacgtttagagttgagatgaaaaacaggtattcagtattattctaaactcttgctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctttttgctattcttgaaatatgattaaaattttaccagtagaaagctactaaaattatacagcaaatcctttttgtctctagcaaggattattgtgagaattattacacagatcttagtgaatcatcagagagcagtggttctcaggtggtgtgattttgcactcaggtggcatttggtaatgtccggagacagttttggttgacaaaactgtgagtgtgctcctggcatctggtgggcaaaggccagagatgctgctaaacatccttcaaggtataagacaaacccccatggcaaagagttatatagtccaaaatgttgatggcactgaagttgtgaaatcctgttctagagaaataaagatcacttaacacaggtatttactgagcattcactgttttgtatctaatgcaccacatgtgcagtgttaaagtataaatcataagccagtatcttccacagtcagatttccttagtgcatagagaaaggattgaggttatgttccatcctatataaattagaatcatggcaaatgataaatgttctgaaataattttttttttctttggcttgtgtcttttttttttagaaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcatgtcttaagatccattcatttttctcaaatggggaagctaaggtacaaagaggccaagagacttacgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaaaaatctgggcgtggtggtgcagttttttgctccctggaggactttgtgttaagcttccttccttgcagctaaatgttgcagacatttaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcaaaacctcatctctactaaaaatacaaaaattagcaggtcatggtggcgggcacctgtgatcctagctatcgggaggctgaggcacgagaatggcttgaacccaggagggggaagttgcagtgagccgagattgtgccactaccctccaacctcccctccaggctggtctcgaactcctgtgacctcaggtgatccgcccacctcagcctcccaaagtgctggggttacaggtgtgagccaccatgcctggccaagatggtgtttatgttaagctattgtgcaaaaaaaaacttttgtaaagaaaatatatcgctgtatcttaattccatatactttcctgactactcttctaccataattgcaaaaattctatgatttctctgtataacatacccatcaaatcagagtgggtatattcagtggcctgaaggggactcaaggtgaagattctcctctacatctgactttagaaaagacgttccacctgccttgtggttcagaaatctagtttcacacagttcatttcaagttagagggaggcattcaggatgtgtctggactagagcagcagtttctgcacatgctcccctctgtcctcattaatttgctgatgcataacttaggaaaagtacactaaaggtctgtttttcttttgccctcacaccagagaacaggctcattaggtccctccaccaagaggtttaggtagcatcaatacaaatgttttaaactcaccatctttactaagcactttatacaactgggagtccctcataaaaatctggtggccgggagcggtggctcatgcctgtaattccagcactttgctgaggtgggtggatcacctgaggtcaggagttcaagaccagcctgaccaacatggtgaaacctgtctctactaaaaatacaaaaattagctgggcatggtggcaggcaactgtaatcctaggtactcaggaggctgaggcaggagaatcacttgaaaccaggaggcggaggttgcagtgagccgagatggcaccattgcactccagcctgagggacagagtgagactctgtctcaaataataataataatataataataataatcatcatcatcatcatcatcatcatcatcatctagccagcttcactacaattatgtaggcaacaccaggaaaacactggaatcacagttgataaaaattaatgaattcactcaaaaacattcagagtgtcatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggcccttttggagtcaaatcttcctggtaaacaaagctacactgcagtcatatttggcatatgtgacatataggcccactgcatttccttccaaaggcaagatgccaagggaaggtgccagtaattttatgaccaatatgacaccattttgtggtgtttgtaagttgaaacaatatatttccctgcattacacaagtttataaaaaacaaacaaaaaaagaggccccagctgtggttgatcgatgatgaatagagcctaaccttccaggcttctcacttgcacaggcccttccaaggtcgtgggagggcccctggaaatttttgtattcataatttttttaatgtttttactagataaggctcaggccccacaaaatcctgaaatcatccctgggttccaatagttacaacccagtaaatctcttgaatgaagcctctatgttattgacaaatactgactggccaagttagcagggtgatagggtctgtctattttgaatctgaaatccatctcaaagacaggccaagagcttattagtggacttaactggattctgctggcccaagcgcagtaaagtcaaacaaccatatcgaggttttgcattggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcacatattggcttgtctatggcacatcgatatcatgccaagaatgtaagcactaagagagaataagaggaaaatccaggctttatccctattgaattatttatcccactattagaatactagtgaggtaggtgtggccacactgtgatggcaaattgagcttcggtcacaaacatgccttactgttccccccagtctactgacatcagcttcctttacatagcggtagatgcacaaaagtttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcttcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgtagatgaggaagttgaaactcagagacgctaggtaatttgctaaggttcacacggctaataagtggcagaaccacttacaagctttgcaaataattttcaatgcagctcttagttcccctgtaataggagctgaatgatgacaatttggctttgtgtgcattgtatcttactttctaacttgaacaggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaacgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaggaaaaaggctcaccatttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatattgggtgagggtctaggtcatctgcttatttctttgactaccttcttccatggaaccagttttccctgacagccttgggattctagcatagatcattttggagtttgtcatttaaatttattttcacagcctgctttggacattttttcagctagagctgttaggatttcagtacatttaagacagtgatgacatgctccagtcctttcatctctctctcctcagttaatagaaaggaaacatagctcatctatctggacctgtacagaagaatttggagggaaaaaaaagaacaagcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctgaaaaaaagcttgccacattttacttccataaagataccaaaaaggcgatggactgggagtcagtgcaccttagtttaatgtataaaatgaaggacttgaaccagaaatggaaatggtcatctactgtgaatctaaaaacactcaaggctgggcgcgctggctcatgcctgtaatcccagcactttaagaggccaagacaggcagatcgcttgagcccctggagttcaagttcagcctgggcaacaaagtgagaccccaatctctacaaaaagacttttaaaaagtggaaacataaatataaataaataaaaacactcatatcatttggtttgtggaaaagagttgctgtagagtcctcaaacttgagccgttgagccagttcccactcagtctctccatggcccaggcacaaccttagtcaagaaaagaatgccttagaacaggaggaaaagaggataatatcgaatggccctatattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgccaagttgtttggctacatactgccttacagtcattatttttggtgtttagaaaaaaatagaaacagggtctcactttgttacccaggctggtctcaaactcctgggctcaagctttccttctgctttggcctcccaaagtgctgagattacaggcttgagatgctgtgcccagcctacattcatttttaatagctgggaggaaagtgggcagaggaagatatagaatgaaggggtagccgactttgtacagagcccaccagtggtcttacaagttttcatgccaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaaagaggagggggatcacaaggcaggacaagctgtgtggctcccagcctcgccactgactcactctgatcttggtcaagggagaatgaatcttcactcctcttttttccatctgccagcatgtttggtcttctggcacctggtgttctatacagtacaacatgcttctttgtgttacattgagacttgatccacgtaccatcaacgcagtattataaagtgtacaattcagtggtggttagtatattctcaaggttgtatagcaaacaatcaccattatctaaccccagaacattttcatcatcccaaaaagaaacatggtacccattagccatcactccccagtgctgtcttcccgcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatgtggttgtttctactttattttggcttttatgaataatgctgctatggacatgcatgtactactttttgcgtggacatgtttttaattctagggtgcatccctagcagaattgctagatcgtatggcaactcttatgtttaactttttgaggacctgtcaggctgatttccacagtggctgctccattttacacttccatctgcaatgtttgagggtttcaatttctccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatatatcttctttgaagaaatatttattcacatcctctgcccatttaaaaaattgatttgtctttttattgaattataggaatttctctatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgaaatttactcccatgtttttgtgtaagagtcttatcgttttggctcttacatttaggtatttgacatattttgcatcaattcttataatcgtgtgagatgtagggggtccaccttcattattttgcacatagatgttcaggtgacgccattacactcaagcctgggcaacagagtgagactccaatggagacggggtttcagcacgtttatcaggctgctctcgaactcctaacctcagatgatccacctgcttcagcctcccaaaatgctgggattacaggcatgagctaccatgcccagccaataaatgaaaactttttcactcaaaaaaacaacaattgtagtgaaaccatagatcagtttggagaatcatgctattattatctgcttcatgtttacagaatactccgttgaatttggtttgccagattttgtcaagcatttttccatctacattcataagaaatactggtctgtaattttttgtgtgtgatgtctttagtttggataccaggttaatatcaccctcatagaataagttaggaaatgttctttcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctttttatgtctctaagaacaatagtaatgtcccctctcatttctagttttaataatttggtcttctgtatttttgcagtgcagtggctcacacctgtcatcctagcactttgggaggctgcggtgggaggattgcttgaccccaggagttcgaggccagccagggcaacatactgagagcttatctctacaaaaaaaatgtaaaagttagctgaacgtggtggcacatgcctgtagtcacagctactcaggtggctaaggcaggaggatcacttgagcccgggagatcggtgctgcagtgagccatgattgttccactgcactccagcctgggaaacagagtgaaaacctgtcttgaaaaatgaacagtaagaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttagccgagtgtggtggtgcgcacctgtagtctcagctacatcttaattttataacgttgtagttcagattaattccaactttgtttcaatggtatacaaaaactttgcttctctaaagctccactctcaccccctcctttatactgttattgtcacacattacatctttatataccttatgttcatcaactagatttataattattgcattatgtaagtatctttttcttttttttttttttctttattttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccagccagtgctttttatttctttgtgcagattcacgttagtactccttatagggcaggtcttctagcaacaaagtctctcagtttttatttatctagaatatcttaatttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgcagtggtgcaaccactcacaacgttgcagcctccacctcccaggcttaagcaatgctgtcacctcagcctcctgggtagctgagactacaggcatgcaccaccatgcccagttttttttgtttttgtttttgttttttttaatttttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgactcttaacgagcatgctgctttcaagcatctgtttaacaaagcacatcttgcaccgcccttaatccattcaaccctgagtggacacagcacatgtttcagagagcactgggttgggggtaaggtcatagatcaacagcatcccaaggcagaagaatttttcttagtacagaacaaaatggagtcttctatgtctacttctttctacacagacacagcaacaatctgatttctgtatcttttccccacatttcccccttttctattcaacaaaaccaccatcgtcatcatggcccgttctcaatgagctgttgggtacacctcccagacggggtggcggccgggcagaggggctcctcacttcccagaaggggcagccgggcagaggcgcccccccacctcccggagggggcggctggccaggcgggggctggcccccacctccctcccagacagggcggctgccgggcagaggggctcctcacttctcagacggggcggctgctgggcggaggggctcctcacttctcagatggggcggctgccaggcgtaggggctcctcacttctcagacggggcggccaggcagagatgctcctcacctcccagacagggtcgcggccgggcagaggcgctcctcacatcccagacgggcatgcccagttattttcaaattttttgtagagacagggttttactctattgccagtgctggtatccaactcctggcttcaagcaattcttgagcctcaagcctcccaaggtactgggagtacaggtgtgagcaaccatgtccagcacctgcattgtttttgaagagaaattagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccatcatttcttcaaatattctttctccttttttctgtttttcttctcctgggacgctcattatgtgtatgttagtaagcttgatgatgtgttccacaaacaggtctctgagattccattcactttcattcatttttatttctgttcctcagagtcaacaatctcaattaaccttcaagttccccattctgtcttcagcctgctgtaatgtgccattgagaacctctaataatttttccatttcagttaccatacttttcaactctagaatttctatttgactcctttttatggtttctatctctttattgatattctctatttgatgagacattgctttcatactttcctttagttctctagtctacagaactgaatcgtttctcttatctctttgaacatattttaaatagctgaattaaatccttctctaggccaggcatggtcgctcgtgcctataatcccagcactttgggaggctgagactgaggttgaggctgaggccaggagttcaagaccaccctgggtaacttcgcaagaccccacctataaaaaataaaaaaatctttgtctagtaagtctaacatctggtccttctcagggacaatttctgcttatttctcccccaaccacgtgtttgggccatactttgtttccttgcatctttcataaatgtttgttaaaaattgaatattttaaataatataatgtagcaattctgaaaatcagatccatgctgccagggtttggtgttactcctgcttgtgttagtagttgctatttatttagtgacttttctgaacttcttctgtaaagtctcgcattatatgtcatgtgttcccactaaagtccctcctcggttagcttaccgatcaggtaatgattaaatgaagatttacttaaattcttggaactgataagtctcctagtttttgccaaggggctctgtgtacatgttggggcataccttcagcactcagctagacaatttacagccatgccttagctttcacttcttgcttgtgcagaacctcaaggtgtcagccaggggtgagagtttatgaacttagtaggtctttcctgaccatgctgacagtctgccctatgcatgcgcgtgacattccaaattgccaggaatatgtcttatggacttctagtttcccaagcatatatcagagtgtttcaaattcctgtggacatcttattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctggttggggatgtgggctgttttccaaggcgactactgagctagagggtgaggaatggtctaaggcaagttaacacaaatctcactgttcttacagaaattttttttgaataaatgctccttgggttgctgcaagactttggttacatttctagagttctgaaaaagtttattgtggtcaatttttttttttttttttttttttttttttgctattttttttggtatttgttgcttttatgaagggatgaatttttggatgtctctttttttttttttttttttttttttgagacagagtctcactctgttgtccaggctggagtgtagtggcataatctcatctcactgcaagctccacctcccgggttcacacaattctcctgcctcagcctcccgagtagctgggactacaggcgcctgccaccacgcccagctaatttttgtatatttagtacagacggggtttcactttgttagccaggatggtctcgatcccctgacctcgtgatccgcctgcctcagcctcccaaagtgctgggattacaggtgtgagccactgcgcccagcctgcatgtctttattccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgctctccagcctgggcaacacagtgagtgagaatgtgtctcttaaaaaaaaaaaaaaaagtctcattgaccatagactaataaactatttaatcatgggaaatgattaggggaaagacataaaaagagaaactgtaatccacttttttttgctctgtcgcccaggctggagtagagtggcttgatcttggctcactgcaacctccgcctcctgggttcaagcaattctcctgcctcagcctctgaaacagctggaattacaggcaagcactgccgtgccctgctaatgagaaattgtaattctcatagaggtcctcccagaggagtagaagaaggttgaaaggcacttctgtatttagtcttctcacaattaaggctgggcccagtggctcacaccagcactttgggaggccaaggcaggcggatcacttgagatcaggagttcaagaccagcctggcaaacatggtgaaactcccatctctactaaaaacacaaaaaatagccaggcgtggtggtgcgtgcctatagtcccagctatttgggagactgaggaaggaggattacctgagcttgggaagaggacgttgcagtgagccaagatcacgccactgcactccagcctggtcaatggagcaagaccctgtttgggtggggaggggaggggagtggaggggagaggagaaaggaaagaaaggaaaggaaagaaaatagaaagaaggaagggggagggaaggaaggaaggaaaaagagagagaaaaagaatgaagaacaaaaatgaaaattttttaaaaacctaaggttaaaataaaccctttttcttcatacagattaaacacgagttcaaattacagctttgctgcttaatagcttggtgacctaggacaagttatctaacctctctgtgcctcagtttcctcatttaaaaatagggcaataataatatctaccacataaggtatttgctgatcacaaatacctggcaacccagtagatactcactgtaataattattatttttataatttctgcctaagtacaaagatgattcttgggttaacctaaaggtagattttcttttatttcttcctgtttcttttatttttcttgttcaccttaaagaattaaaaagaaaatcgattccagcattttggaataaaaatttgcatcaaaatcaatttattcattttattgacatatgaacaaaatgtcatttgtttattcaataaacatttgttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaaaaaaaaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggtagatcacctgaggtcaagagttcaaaaccagcctgaccaacatggtaaaaccccgactctactaaaaatacaaaaattagctgggcgtggtggtgggtgcctgtaatcccagctactcggaaggctgaggcagaacaggagaatcacttgaacctgggaggcggaggttgcagtgagccaagatcgagccattgcactccagcctgggcaacaagagcgagactccatctcaaaaaaaaaaaaaaaaaaaaaatagatgaacaacttgaattatgatgagcaacttgaattatggaggatgctagaaatactgtttcctccacagtcagggcttcctaccaacatagtcacttttagggtttttgacctgaaaagttctgtggcatattttttctttgctatccactttttttttccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattccattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaactaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaagtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaatttttttttttgtttttgaaatggaatctcactctgtcgcccaggctgcagtgcagcggcatgacctaggctcactgcaacctccacctcccaggttcaagtggttctcctgcctcagccttccgagtagctgggattacaggcgcatgccaccacacctggctaatttttgtatttttagtagagacaaggtttcgccatgttggccagggtggtttcgaactcctgacctcaagtgatccgcctgcctcagcctcccaaagtgctaggattacagataagatccaccttgcctggcctcactcagcagaattttttttgagattatgctaccatccatgttgttgcacctatcactacagctggccctccatatctgcaggttcctcatccatagattcaacgaaccatggatggggaatatttggaaaaaataaaatatataaaacaacaatacaacaataaaagcagtagaaaatttaaaatacagtataattatgtacataccatttacactgtattaggtacttagagtatacctgaggctgtatacaaacattatgtcatttcataaaaaagaactcagcatctgtggactttggtatctgcagggggtcctggagccaatcccctgcagacaccgagggacaactgttcactcctttttattgctgagtagtattccggttgtgtggaaatgccatctctactaaaaatgcacaaactaggcaggtgtggtggcacatgcctgtaatcccagctactcaggaggctgaggcacgagaagtgcttgaacttgagaggtggaggttgcaatgagccgagattgcaccactgcactctaacctgggcgacagagtgggactctgtctaaaaaaaaaagtaagaaataaaaatgttttctgaagagcagaagtttttaattttgaccagctttaagttagcatttttttcttaaatggcttgtgattttttgtttcttacctaagaaatctttaagaacctgttgtctaatccagcgtctaaaagattttctcctatgtcttctcccagaaatgatacacatttaggtctatgatccattttgagttaatttgcatatgtgatgtatcttttttattttttatttttttgtagaaatgaggtctcagtatgttccccaggctggtctcggactcctggtctcaagtgatcctcctgcctcacctcccagagtgctgagattacaggcatgagacaccgtgcctggccttctttgcaggatatatatatagatatagatatatatataaatcagccaggtgtggtggcacacgcctgtagtcccagctactagggaacctgagtcaggaggatcacttgaacccaggaggtggaggttgcagtgagccaagatggcaccactgcactccagcttgggtgacagagcaagaccctgtctaaaatatatatatatttatatatatgtacgtgtatatatgtatatgtatgcctgcggggccctattgtgagtttgttacacaatttactgcaacttcaattgtgccaccagcccccacaatatggcaagctaaatagagactcagttatgctagggctggttgagggcattttgcaagattagcatggaaagggcccttcatttagcactctgctccgttcatttttgtcaggtcactttcttatcttgaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaaatgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagatttgtcagtatactttaaaacaatcctgggaacagttctagattgaaggagactaaagaatcatgtactaagtgtaatgtctgatgtttgattggattgtgaattttttaagccatgttatgattgggacaattgtgaaaatgtgtatacggaccgcatagtagacaatgataatatgaagttccattgagtgatgatagtcctctggttatgtcagagaatgccttggttcttaggggctgcacactgaagtcttcaatggtgaagggtcattatgtctgcaactgactctcaaatggttttgtccagaaaatgtatagacatacacacacggaaagctaatgtggcaaagtattagcaactactgattccagatgaaagttatacaggtgttcattataccatttgaaaatgtttcccagccatcctaaggcttaaaggaaaaaaagaaaatgtttaaaataaaaacttgggggcagaaaaagaataccaaaaattttgggctcatgcctgtaatcccagcactttgggaggccaaagagagagggttgcttgtgcccaggagttcgagaccagcctggacaacatggtgaaaccccatttctacaaaatatacaaaaattagccaggtgtggtggcacacacctgtagttctaggtactcaggaggctgaggtgggaggatcacttgagcacaggagacagaggctgcagtgagccaagattgcaccactgcactcagcctgtgtaacagagcgagacccggcctcaaaataaacaaaagaaacacctttgtggcagaggtaaggttgctatacaacaaaatgctgggttacggttccgggtccattccatatgaagatcagaggcttccactggacccaaaggaatactactagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactcactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatctttcatgacactggcattttttaagagtcaaagatagttgtcttgtaaattgtcccacaatccagatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaaaaaaaaaaaaaaattagctgggcatggtggtgcaagcctatactcccagctactcaggaggctgaatttggaggatcccttgagcccaggggggttgaggctgcattgaggtataattttgccactgtatttcagcctgggtgacaaaataaaaataaaaataaaaaataataattttccccttggtaattaataaataatctgtgggttgttactttgagttcagtgaagatcctgttctcaaatgttttttcacccaaatgtgcatcaatgataatccttgtctgaatgaatttgtattacactgacggttgcaaagtgacacttttaaaaattctgtcattccttctacatttactagctggcattatttcattgaagaagaactcctcctctttctttttcaatatcactcttcgtggattcttctttatattaaatatgtggtaacttattgttgttattcttttgaatgctcaaattgtccagatttgaccaatgcagtctttgttattttttaactccgcaatccaggttaaactaagctatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattccagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaacaataatacaaaacacacaactgcaagaaatgcctttgaagaaaatgattttatggaaaacactaacatgccagaaggaaccatctctgaaaacacaaactacaatcatcctcatgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccagctacttggaaggctgaggtgggaggatcacctgagcccagggaggtcgagtctagtgaacggtgattgcaccacggtacccaagcctgggtgacagagtgagaccctctttcaaaaaaataaaaaagaacctgtcagctactcacctggaatactggggttttgaatagttagctctcattctggttttttttttgtgtgtttttttttttagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttactgcagtgtatatttcaggatttttaaaggatcctcgctttcagatctctgtgaattgaaaccatgtgaatcccactagactattttaagaagtcgaaaatttctcccacccaaaactatgtcaacaattggatgtactcatcaagtcacccttactctgccactaatttatttccttgttgctgaaatgatgagagaggtataatctccaccctcacggagttgtcatcaccctggagaggaaggagagagccaaaagacatacgtattgtcttgtagacttattagatttacacagtatcgtcctccagtgtgtaaggcattgtctaaataggtccagttaaagcactacagagtagccatcttttacaaaaatttttggccacatttttaagttcactggtgagggggaacgtctcatactctagccctcctgagcctagaccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgccaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctagtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggcttaagggatcctcctgcctcagcttcctgagtggctgggactacaggcaggcagctaatttaaaaaatgtgttcgtagagacaaggtcttgctatgttgcccaggctggttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaaaaaaaaaaccaataaaaatacaaacagaaagtacaatataacaactgtcaacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtagatgagacttataatgaataaaaggaatcaatacagatttggagacggtggttgttgtcatagataatcttaattgcgttttcttctaaaacagatatgttgtcaccgaaggtcattacaagaagatgaagaaggattctcaaggtaaatattagtctggtgattttttttttcttctcttttgagacggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagagagggcacttgtctccttcaaggctgatggaaggtaggatatgtgagtccttcctcttaagtggcaggaaacagtattttctcttttatttcttttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaggaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtgagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatatgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatgaatgaaaattgtgattccgatgaagcctgccagagaaacaaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacactaaaaaggcaagagaagccctaagcagagtgagcaccagactccacaggttaagggctcagtcacacaggaccatccgcatgtcagaccccaggtgcaaggccaagcatcacctatgcatctgaccaactggctgtaaattggaggtccccacaactccctcctcaggtttgaacatttgctagaacagctcatggaacccaggaaaacagttttcttactagtgctgatttattacaaaggatattttaaaggacacaaatgatgaagccagttgaagagatacacagggtgaggtttggaagggtccttgtggagttggggtgcaccactctcctggaacatggatgtgttcgccaacccggaagctctccaagtcctgtcttttaaggagttttctggaggctttatcacgtaggcatgattgagctccagctctactccccacgccagaggatggggaatggggctgacagcacaacgcttccaaccataggtctttttggtgaccagtccccaaataaggagcccaccaagagtcacctcatgagaacaaaggacgcttctatcacccagaaaattccaagggatttaggagctctgtgtcaggaaccaggtttaaggaccaaatgttagaacaaaagatgtgcaaccataaaaaacagcgagatcatgtcttttgcaggaacacagatggagctagaggccattatcctcagcaaactaagacaggaacagaaaaccaaatactgtatgttcttttaagtgggagcaaaatgatgagaactcataaacaacagacactgggccctacctgagggtggagggtgggaggagggagaggagcagaaaaaactattgggtactaggcttggtacctgggtgatgaaataatctgtacaacaaacccccatgacacaagtttagctatataacgaacgtgcatatgtaccccctaacctaaaagaaaagtttaaaaaggaaaaaacacctaggagaaaagaaaaatgataaattaacaaaggacaatgctcttagcaccgccatcattcaggaatttccaagggttttaggagctttgtgttaggaactgggggcagagaccaaatatatatttcttcttatgttacactaccccagataggaaaacagaaattactctagatatttcaaacaaaaaagggttgtatataggcaattagtgcttatcactggaggtgctagaggtggtgaaggttgtggggatggggttgcaccactggctttcaggctactttaccacagctgatttccagaggatggaagaagtcaggaaacttgggaaaccgctgctgaggtccttgcagccccacggtccccaggctggtgactggtgggggagtatggagtccagctgaccaccagagcctgcacacctgctgctatgggggaggaaaggatgacttctacctcctttccacattccaaattccacgtgactacattttattggcagcaccccgctggcaagtgagccttgatgtgtgcttcctgggcttctggcacctgcacagaaaggggtgaaatgagtgtcacgagcagccaccactctgcatcacacctccacatccaggtgtgctggagagccccacttacacttggagtgtcctggtgccctacccacttttggtaggtgtttgggtgtctgaggctttgcaaaagaagaaggtggggagtctatggtggagtcacatggtggagacctagctaagtcagaggcctggagaggtgtcactggctgggcagcaggtaacacacaatcatcctgagctgattggagaaacacctgggattgattcagagttttttctggaatgttttcactggaatgaaagctgagcggtctgcaggccatatagtattggagaaaacttagccctcattgaaaaaggctgccagagaaaagatatccacagggaaattcaggagttttgtttgtttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattacaggcacccaccaccatgcccggccaattttttttttttttttttttctaaaaacagtttcaccatgttggccaggctagtcttgaactcctgacctcaagtgatccgctcaccttggcctcccaaagtgctgggattacaggcatgagtcactgtgccccgccaggaaattcagtttctgaaaatacacctgtggatctctagccttgaacacccttggatgctgctttaaatgactgatcctcgatgcctcccttctaactcacactcccctatatcaatctcccagaaaaagggacctcttttattcttttttttttttttttttttttttcagagacgggcctcactttgttgcccaggctggttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggcccggcgcctggggatgggaggcaggactgcaccttcacagggacgcttccaccctaccccggaggtcagggcctctcgcccagctctggctctgaggtcctggagggagggagatgctgttgcgactcagaagattgggggagggccacccccattcgagaagagtgaaaatcctgagcctgaagaagtggaaccggttggagccgaggctttagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactggcttacgacatgagagctcaatatgctccttatttaacgcactgttgtatcaggtccctgtgggagccactggctctatagcctaataaaggagcgggtgcacgcactggattggtgagctaccgccactgcaacgcgtcctaatcaaccatcctaaacggcggctggaacaaggttctcgcaggcctgtgcttgggcttgaacgctggtccagccgctgcgctctgtggctccctgtaggcctgcggatcggccagggggctccgttccttttgggcggaggctgaagaagcagcggctgcaccagagaaggccctctgggtgaaggtgggagcgcacggggcccgcggaaccacctaaggcgacttcagacgtgggctcggaactggcagcctttcgtttctgcttcattccaaggccagagcaagccacgtgggcaaacccaaagccaggggacaggaaagtatcctccacccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagcacatagtgctaagtatttggcttgtaatctgtagagactctgccatttggagctgggatctgtccccagagctgtcagacaccaaatcccgtatctactgccacccaaagggacctccagaagaaaggggttatacagggtcaaacaccaaggcaggttagtgaaatttctctagaggccatttaaagctggagtctcaccacctgaactgccctcagaggaaggctgtctagggcacaaacctagtcaggggtccacatggacttaaggacaatttttttttttttttttttttgagacagtctcattctgtcatcaaggctcgagtgcagtggtgtgaactcagctcactgcaagtctcaacctcctgggctcaggtgatcctcccacctcagcctcccgagtagcgggaaccacaggctcgtgccatgatgcccaattaattttcttttaaattttttgtagagatgaggtctccccgtgttgctcagtctaatcttgaactcctggactcaaatgatcctcctgcctctgctcctcaaagtcctgggactacaggtgtgagccaatgcacctggcctcttatgaataattttaaaaacaatgaggttcaccgtcagagcccctgctgctctaccaagtcccttggcccctctcaacagggcaaaagcaagatgagccccagatgttctgcttaatgaccacctttcccaggagactttgctctttaaaggagaaccacttagagatatgagcaaccttaaagaatgccaccagcactagtgaatgccaggcacgggccacgtgggtggagagtatactttagggcagtcactcatggtaaattatttccaccagcccccagaagtgactattcaatgtccaactatgtcaggcccaggctaataaaagtagaggcatgaggaacctagggttgttctgaagtgccttgattatggtacatgtggaagattttagagcttgttgtaaaaagtgatgacccatggccccccaggctgggtctgggattccctttgtggattacaagaggatattatacagcagtttttaaaaatgaggcagactgggacaatctatctccaagatgcataggtgctgttaagggaacaaagcaagatttagtagggcgtgtatagtatgctactgtgcgctgtgcgttatctgtacagaactgtgaggtctgatacagtagccactagccacatatggctatttacatataaatttaggttggccacagtggctcatgcctgtaatcctagcactttgggaggccaagtgggaggatagcttgaggccaatagttcaagaacaccctgggcaacatagtgaagccccttttctacaaaaaatttatttatttatttatttttattttttttgagacgggtctcactctgtcacccaggctggagtgcagtggcgcagtctcagcttattacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttaggaggctgaggtgggaggatttcttgagcccaggaggtcaaggttgcagtgacctatgactgcaccactgcactccagcctggacaacagagtgaggccctgtctcaaaaaataaataaataggagtttgaggccatgttcacacatcactgcagtccagtctggtaaacagagcaagacgctgagtctttaacaaaaaaaaaaaaaattttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaactggtaatggcggttgccttccgggagggaaactgggagagtgcagggctgtatgcccttttgtacctcttgaatttcatatcatgcgtttgtactaggtgtttacaaattattttaaaaacatactgggaattaggaatccccatatggaatcactgcagtgggacactgattcccaaaaaattactttgcaatttgcctaaaacaaattaagctaatagctatcatgatttcatatttaatattttttcacagcttagagtttttttagctcctgttgctatctctctgctcttatgagctcacagggtgacaaagtgaattagtaagtagcaggagaacattaaaggaaaaactcctgggcaacagggcaaaacgccggctctacagaaaatacaaaacattagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagatatgagccactgcatccaactttggttcttgtttgtctgttttgttttgttttggtttgtttttttgacagagttttgctgtgccacccaggcagtgactcagcctcggctcactgcagccttgaccttctggcctcgagtgatcctcccacctcagcgccaccccccactgccctccaatatctgggactacaggtgcgcgtgaccgcacacagctaatttttaaattttttgtagagatagggtttcactatgtggctcaggctggtctccaactcctggactaagcgatctgcctgccttggccacctcccaaagtgtgagccaccatgcccacccattgaacattgaagctagactgggcaaacccttaagcctaaaccagtaacagtttttcacaagttcatagatgttactgtggttaataacacacaaattcatttaaaagcatgtgtgtccacatagtaatttttggtccttatttttatttttatttttcagttaatggatattaaagatacaactttattttgttttttttgagacagggtctcactctgtcacccaggctggagtgcagtggcatgatcagagctcattgcaacctccacctcctgggttcaagagattctcctccctcagcttcctgagtagctgggattgcaggtacatgcaaccacacctggctaatttttgtactttttgtagagatagggttttaccatgttgctcaggctggttttgaactcctgagctcaagtgatccacctgcctcggcctcccaaactgctgggattacacaagtgagccaccacacccggcctaaagatataatttctatcatgaggaggtccaagaactattctctttttctttttttaatgttagaaagggattaactgggtatgtgctgcagcaaagggaggggaaattaagcaagaagagaagggagccaggaaataaaggccccaacccaggaagcagttaagcaaagttccaggatgacccatgtgacaagtttaggggataacttgagcacatggaggacagaacttggagagggcactgtgggcctgggcgccacctgctccgccagagcactggaagagaacgagggcacgataatggcagatggcactgaaagaaaaggagagagcttgaggcacccttgggggaagcagccatcatcagagtgtattttatttttattttattatattttgagatagagtctcactctgttgcccaggctggagtgcagtggcatgatctcggctcactgcaacctccacctcccaggttcaagtgattctctgcctcagcctcccaagtagctgagactacaggggggcaccaccacacccggctaatttttgtatttttagtagagatggggtttctccatgttggccaggttggtcttgaactcccgacctcaggtgatccgcccaccttggcctcccgaagtgctgggattacaggcgtgagccaccatgcctgacctcacagcacattattaagctctgtggtgaataatatttatatagtcacaattctgtaaacactgttcattttctacaaattgtggcaaacccaaacctcaagaatggacagggctagggtgtaaaagagctaagtccttgccaggtttaccaggaaggcaacagacagtgtctaaaactatgagacagctgggcgcggtggctcacgcctgtaatcccagcactttgggaggccgaggcgggtggatcacgtgaggtcaggagtttgagatcagccttgacaacatggtgaaaccccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaaggagaaaaatatttatccctaataactaatggaccatcttacgccgtctataaaaatatcaattaagaaatcacggccgggcacagtggctcacgtctgtaatcccagcactttgggaggccgaggcgggcaaatcacttgaggtcaggagtttaagactagcctggcaaacgtggtgaaaccccatctctactgaaaatataaacaaattagccaggcatggtgacgggcacctgtaatcccagctactcgggaggctgaggcaggagaattgcttgacccaggaggtggaggttgcagtgagccgagatcacaccacttcactccagcctgggtgacagcaagactccgcctcaaaaaacaacaacaacaacaaaaaacgcggtgatacacgcctataatcccagcactttgggaggccaaggcgggcggatcacaaggtcaagagatccaagaccatcctggccaacatggtaaaaccccatctctactaaaaatacaaaaattagctgggcatggcgcgcacctgtagtcccagctacttgggcggctgaagcaggagaatcgcttgaacctgggaggtggaggttgcagcgagccgagattgtgccactgcactccagcctggcgacaaagcgagactccgtctcaaaaaaataaaaaagaaatcagaaactgttcaaattccaatctatacaagtgaaacctacacagttaaatgtcttaatagagagctaaaagcattaagttctgtcatactcaacatactgatgaaaaaaatttgaactaaaagacagcctgatctttagaaactggcagaaaaaataggggctgcatccaagaccactcacggcacgtccattcttccagcagctcccaactgctattttatgaaaagtccaaatttcccaccccaaggtcctagagtacagccagctccctaccatcaaaaacaatagctaccaaaactcagtaaaattaggcttgttatgaagagaagattgaagaaataaaggtatttatttcatcttggtatttgaatgtggaaactcccagtagggtaagaaaaaagaattctgccagagaaatgatgaagtgaaacctcaaacaatttgggcttttgagtgcctactgtcatccagccacgaaatgaagcattttacataagtaatttaagcccagtgatgcaggcagtaagtattatctccattttaagatgaggaaattgagacagacgagattacctaactctctcaaggtttcaccacagagctgtggttcaaacccatgtgttctagttttattacagttaagaaactgcaagagtttgccaatttgtcaagtgccagtccaagataaatggacactctgagtatcaaaaaaatacataatctgcagatcaaaacacgaagatacaaacatctaagagtcaccatggaagttgcggggcatccagtggtttttctgaaaatccatgaaggaaaagaataaagcatttttccagcctctcttctacaaactatatttcagggaaaccaaatatttgatgagggaattctttgtttagaaggattttagctaataaatgcagaggaataacaagatttaggaggggggagaaatcaccattttgtgacttctaataaaataatgggtctaggcaacagttttcaatggatgctaaaacgattaggtgaaaagttgatggagaattttaattcaggggaattaggctgataccatctgaaaccatttggcatcattaaaaatgtgacaacctggtggctgccagggaggaaggggagagggtgggggaagaacagaagttatagtttatgggcacaaagttttggttttacaagatgaaaatagttacagaaatgaatggtggtgatggttgcagaatattatgactgactatacacttaaaaatgtttaagatagagctgggtgcagtgttgcacacctgtagtcccagttatgcaggaggctgaggtaggagaaccacttgagcccatgagttcgagaccagtctgagtaacatatagagacctcatctcacaaaaacatcactaccacaaaacaaaacaaaacaaattgttaagatgctaaattttaagttatgtgtattttaccacaataaaaaaaaatgaggccgggtgcagtggctcatgcctgtaatcccagcaccttgggaggccgaggcgggtggaccacaaggtcaggagttcgagactggcctggtcaatatggtgaaaccctgtctctactaaaaatacaaaaaaactagccggacgtggtggctcacgcctatagtcccagctactcgggaggctaaggcaggagaatcacttgaacccaggaggctggggttgcagtgagccgagactgcaccactgcactccagcctggccaatagagggagactccgtctcaaaaaaaaaaaaaaaaagaaaagaaaacatagttacccagcaattccacttctaggcatatacccaaagaactcaaagcagggactcaaacagatacttggacatgaatcttcatagcaacactattcataatagacaaaaagcagaagcaactcaagagtccatcgatagatgaatggataaacaaaatgtggtatatccataaaatagaatatcattcagccataaaaggaattaagttctgatacatactacagcatagatgaaccttgaaaacattgtactaagtgaaagaggccaggcagctaaacttccaaagactaatatacaattccactgaataggcaaattcatagacagaggatagaataaaggctaatgaggggtgggggagaagagaatgggcagttattgctaatggatacaaagtttctgttggggatgatgaaaaaattgtggaactggacagtggtgatggttgtaaaacacggtgaatgtacttaatgccactgaattgtacacttaagaataaacttgtaaattttatattatatatactttgccacaataaaaatttttttaaaaatgtctaagtgtgacaaccgaacttctgtgttaggataggaagaatacttatgaagtattcttgcccctgaaatgaaccaaaatctaatcaagtctctagaataaacaaccagttcacaggaaatccacagatagccaagcaagttagatggcactataataaagtaatcaaccaaatccagaatgtggaataagcagttaaaaaaaaaaaaaaaaagagggggggaggccaggcgaggtggctcacactatggtctcagcactttgggaggccaaggtgggcagatgcttgagcccaggagtttgagaccagattgggcaacatggtgaaaatccatctctataaaaagtacaaaaaaatttgctaggtgtgatggtatgcacctgtggtcccagctacctgggaggctgaagtcagacaatcgcttgactccaggaggcagaggttacagtgagccaagattgtgccactgcacgagaccctgtctccaaaaaaaaaaaggaaaaaaaaaggcatagagaaagaacaactgctgtagaataaaagactaaagaggcaaaacaacaaaatgcactgtgcgaactctgatccagatgcaaacaaagcagatgtagaaaagatgtagaaaggatactttttttttctcttttttttttttttttttgagatggagtctcgccctgtcgcccaggctggggtgcaatggcgcaatctcggctcactgcaacctccgcctcctgggttcaagagaatctcctgtctcagcctcccgagtagctgggattacaggcatgcaccaccaagcctggctaattttttttgcatatttttagtagagacagggtttcaccatgttggccaggctggtctccaactcctgacctcaggtgatccaccagccttggcttcccaaagtgctgggattacaggtgtaagccaccacactcagccaggatacatttgatacaactggagaaattagaataaggactaggtgctagatattaaagaattattattaattttggagatgttataatagcatgaagattttatatatatatatatgccttatcagttggaaatgaacactaaaggacatgtgaataaaaggcatcatgtctgggatgggcaaaatgcttataactgttgaggcttggtgatgggtacatgggggttcgttatgttatcctctctgtctttgtatttgttttagattttccactaaaaaagttaaaaaaataaatgcactactttgagaaaaaacattctaaaatctatagcctggaaaagataactgcaaatagagttaattgccaaaggtaacagctaaaacaatgatataaaatataaagggacagtcgacttgggtatttcatctggaaagactgacgaatatgtaagtctttactatcaagtacatgcaggagaatctccaaaacaaacagactccaaataaattctaaaatgagaaatttgtagattccatatggttaatattttacatgaaaatcggggtgtaaaaactatagtcagccctctgtatccacagattcaacccaccttgaaccaaaaatattaaaaagtaataacgcaagccggacacggtggctcacgcctataatcccagaactttgggaggccgaggcgggtggatcacctgaggtcgggagttcgagaccagcctgaccaacatggagaaaccccgtctctactaaaaatacaaaattagccgggcgtggtggtgcatgcctgtaatcccagctactcaggaggctgaggcaggagaaccacttgaacccgggaggcggaggttgtggttagccgagatcgcgccattgcactccagcctaggcaacaagagtgaaactccgtctcaaaaaataaataaataagtaaataaataaaaataataacgcaacagtaaaaaaaaaaaatacaaataatacagtctaactatatagcatttacatgctagtagacataagaagtaatctagtagtgatttaaagtagacaggggggctgggcacagtggctcacgcctataagcccagcactttgggaggccaaggtgagcgaatcacctgagatcagaagttcgagaccagcctgaccaacatggtgaaaccccatctctactaaaaatacaaaaattggccaggcgtggtggtgcatgcctgtaaccccagctacttgggaggctgaggcagaagaaccacttgaacctgggaggcggaggttgcagggaggcaagatcacaccactgcactccagcctgggcaacagggcaagactctgtctcacaaaagaaacctccccagtaagtataaagagaccctaagagaggaaatggctgacagtgtaaatagagcagagcaccagaaggtatcacttcaagcatccgtctttagagacatttcacagaaacagtatcgaggctacaaaccgaataatctttaccttttgtgttctggaaaaaatgctgccacagaggtctgattttgaagtggctgccaacatcccagacagcgaaggtgttatttttatattctactgtctccacacagaaacctaaatgaaacatggggaaaacatttaattatgatttgtgctggttgaacaattcaaaataatttcaacatgcggacagtacttttaatttacaaagcagcctgctagtcaaagatctatagccttcaaacagaatgtgctggccccctcgcccattcatcaggacaggtgtctcaaaccttctctactctccaatctctagccacgcacctgccctttctctcagcaggagactatcacagtgtacttcagagcagagaagccgccgatgggaatgacttccacttccaccatacagtgtaaaagccagtctacatctttacccatgcttttcttcctccctcttggaacaacagaagaaggtaactctcttccaccaactccctccctctatgagccagatccaccctacccagactgtctggaactttttactattcctattctctcccatatctgaatatctccaatctgttcaccttggcatgcttaagccttttacatctttaaaaacaacaaaacaaacctttccttgatccccacatcttcatcgcactctcttccttcacatcttcaccctctatttgctttttttttttttaagagacagggccttgctgtgttggccaggctggagcacagaggtacaatcatagctcactgcagcctcaaactcctgtgctcaagggatcctcctgcttcagcctcccaagcagctagaactataagcatgagccaccatacctagctaaatttaaaaaattttttgtagacacagggtctcactatgttgctcagattggtctaaaactcctgaggtcaagcaacctgtccactaagctttcttcggtcctctcacgcaacagcaccttagctctgctccaccattgggtagctggttttcagtaaggtcagcagtgatcaccaggtcaataaatctaacacaggccttctcagttcttccataatttgatcttctatctgacgctactgctcactccctccttgacacccttccccagcttcccttttccttctatctctatggctgtactgtctcagtctccttagtgaactcagccacgtttaactgatcctgcaatgatgggagtcgccctggctctcactggccccatccactctcctctttctgcacccctccctaggcaatctcactcactcccacgacttcattcctatctctgtactaactctgagatttatatcccccaacctagccctctctcctgagcttcaggctcataatctaacagctttggcaaatgtcttcaaggccccaaaacaaggtgatcagtcaaaaatggaatttaaggtccctacccccaacctcctcctctgctagttatcccatcattgacttcgttccacaagctgatagcctgagaggtgccctggaaacatccgatgctcgcacccctagaaccctactaccacaccttatcaattcaaccccttcaacaactaatagtcaccctaacccaacagaccatcatttctagcctcaattcctgaaaccatataactaatttcacctcagccactctccctctctccatccggtcaccatcttctaaacaaagcaatagcttaaaaacacatagtgtggtcacgtcatttctctacacatttatgtttgattggaatattttcaaacttaaaaaagaaagaataatcgccccaaaaaataaaattaaaaattaaaaaaaaaagaaagaataagccgagcacagtagctcacacctgtaaccccagcactttgggaggctgaggtgggcagattgctttgagctcaggagtttgagaccagcctgggcaacatggtgaaaccctgtctctacaaaaaaacacaaagattagccaggcattggtgccgtgtgcctacagtcccagctacttgggaggctgagacaggagaactgcttgaagcaaacattgcagtgagctgagatcacaccaccgcaccccagcctggatgacagaataacatccaagaaagaaaagaaagaaaagaggaagagagagacagagagagagagacagagatgggaggggaggggaggggaggaaggaaaggacagaaaagggagggagggagggagggagggaggaagggaggaagggaggaagggaggaaaggaaaagaaggaaagatgtccccttagcggcttcccacacccaaatcccaaacatgactgtcaagacccaagcaagctgggtctgctcaccttccaaacctcaattctagtcatgccttattttagtgagagacactcgttacattgcaacaatctaaattcttgctaaataaataaatacaatgccattccaatcctataatgatggtaggggcaggggcaggaaacttagcaaaattatctaaaatttaacctggagaaataaacaagtaagcataaccaggaaatctctgaaaatgagtaatgaattatttttaaggatatgccaagccctagtaacacttgaatagagttcaaatataaatgcaacaggtacttgcccaaaaaaagacacacataccagtgagaatttagtatgtaacaaagaaggcatttcaaatcagcatggaaaaattattcaataaatgacattgaacaactgtctaccccagcaccgtccaatacatagtcactagccatttgtgactatttgtttatgtttttgttttattttgttttgtttttgagacagagtctcgctcttgtcacccaggctggagtgtatggtgcgatctcggctcactgaaacctccgcctcccggattcaagtgattctgctgcctcagcctcccaagtagctgggattacaggcgcctgccaccacgcccattttgcaattttagtagagacggggtttcaccatgttggccaggctggtctcgaactcctgacctcaggtaacccgcctgcctcagcctcccaaagtgctgagattacaggcgtgagccaccatgcccggcctatttatttattttttgagacacagtcttgctctgtaacctaggttgaagtgcagtggtgcaatatcagctcactgcaacctgtgcctcccgggctgaagtgattctcctgccttaacctcccgagtagctgggattacaggtgcatgccactactaatttttgtatttttagtagatatggggtttcaccacgttggccacgctgatctcgaactcctggtctcaagtgatcttcccacctcaacctcccaaagtgctgggattataggcataagccactgcgcctggcaacgtggctatttaaacttaaagttaaaatcaaaaatcaatcaataaataaaaataaataaaaaataaacttaaagttaaatacaattaaaagttcagttcccggctggacacagtggctcatgcctgtaatcccaacactctggggggccaaggtggacggatcacccgaggtcaggagttcgagaccagcctggccaacagggtaaaactccgtctccactaataatacaaaaattagccgggtgtggtggcgtgcacctctaatcccagcttctcaggatgctgaggcagaagaatgacttgaacccagggggcggatgttgcagtgatctgagatcgcgccactgcactccagcctgggtgacagagcaagattccatctcaaaaaacaaaaaagttcagttcctcagttgcattagccacatttcaagcacatgaacagtcacatggctattggctacgacactaaacagcacagacacagaacattttaatcactgcagaaagtgcctcctgggcagcactggcttatccatttgaaaaatttaaccaaattactaccttacacacaaccatctcataactcgaacattctcctcggtttcccactcctcaatcgatgcaatctctgcagctactgcccaagttgaaagttgatcatttggagaccaggtgcggtggctcacgcctgtaatcccagcacttagccgggcagatcatttgaggtcaggagttccagaccagcctgcccaacatggtgaaaccctgtctctaccacaaatacaaaaattagccttgcatggtggtgaacgtctgtaattccacctactcaggaggctgaggcatgagaatcgcctgaacccaggaggcggaggttgtagtgagccgagatcgcgccactgtacttcagcctggggtgacagagcgagactctatctcaaaaaaaaaaaaaaagaaagttgatcatttgagtcctgtgcctaattcaatattcagaacagaacagtagtaatgttcacatgccacctgtggggtgtatcctcagtcagaagtttggatctagaggcagttcacaaggcaaagattcagttctgtcaaaactcgctttgtaaatctcttaacaagccggtaaaacacagtgctggttcacagtaagagcagtgcagccagcttgtctatttctctagttggacatcatctcaagcagttggtttgagccagagtgaagaaaagaaatcacactccatctctaagcactgggagcgtacttggtgtagagatgagatgctgccactaaggaaggccagctggaacagaggctgactgaggaggcaccagcagattcccagctcccacctcagccttctgctgggacactagctgcgaggaatgaggggcagaactaccctccctgttttgcccattatctttttcttttttgccaagcaaatggggttaaatttgcttagcctccatgtgttcacatgtctcccttgtgaacctaagaatgtgcaagccactagaaaaggatacataacctggccaggcgcggaggctcatgcctgtaatcccagcactttgggaaaccatggcgggaggatcgcttgagcccaggagttcaagaccagcctaggcaacatggcaaaaccccgtctctactaaaaatacaaaaattagctgggcatgctggtgcacgcctgtagttccagctactcaggagggagatggaaggatcacttgagcccaggaagttgagactgcagtgagcagagatgtaccactgcactccagcctgggtgacagagtcaaaaaaaaaagaaaaggatatatataacctggtttttggcctctaaaaatgtatgctcatggagtagacaagatttttaaaaagaattattcaataacataagaagcatgtaaaaataaaacatatttctctggtgaaacagaacctaaaaaatatatataacatactaaattgtaaactggaattgccacaggtctttcattaacttacctactgtagggacggcaggcacagtctcccccagcttcaatttatacaagatggtggtttttccagctgtatccaaactcaatataagaatccgcatcttttttttcccaagtagacttttaaagagcttttcaaaaatgtttcccattgtaatttaatcgaattctgtaacatgacaagaaaagcaagccaaataattgttctctgcagagatatagaagcaacacgcagaaaatacaagtgtcaattagaaatggctcccaggaaaaattcaacaattttaggtacactttggccaatgagtagtgagtcttgtcttcaaagggaaactcaactaaacctttccatgccttaccagaaaattctattttccactgcagcatccaagagggatatgcaacatagcctcagcactgctatgacagtggcagcctttagtcatttagtacagaagtacaaggccaggtgcggtagctcacgcctgtaatcccagcactttgggaggccaaggtgggtggatcacctgaggtcatgggttcaagaccagcctggccaacatggtgaaaccccgtctctactaaaaacacaaaaattagctgggcacggtggtgcacgcctgtagtaccagctactcaggatgctaaggcataggaatcacttgaacctggggaggcagaggttgcagtaagccaggaccacgccactgcactctagtctgggcaacagagcaagactgtctcaaaaaattaattaattaattaattttttttaaaaaacaagtacagaagcaatgatacaacaaatacaactatacctcattctaaattctactgaaatgagaatttatgaaacagagaagctttttattttatgcaatataaaacaaagtctttaagacaggttaaacaacaatatcccttggaaacgtagtagttccttatggctagcagacaccttggaaataacctaagaaatttcagaggcaaagaaattcagcgttgggaagcttcactgccaagagagataacttggcagagttgaggaggcaccacagcatccagttttcgtttgagttttttgttttgttttgagacagggtctcgctctgtcacccaggctggagtgcagtggcacaatcacggctcactgcaacctcaacctccccatctcaaacaatcctcccacctcagcctctggagcagctgcgaccacaggcatacgccacctcgctcagctaatttttgtattttttgtggaaatgaggtctcactatatttcccaggctaatctcgaacccctgggctcaagtgatcttcccacctcagcctcccaaagtgctgggattacaggcgtgagctaccaggcccagccagtatccagtgttctattgctgtaactatcaccttactctcaaccagttcttagaactttttatttaagtataatttacatacagatataaacatacatgataactgtaaagttcaatacattttcatgaaccaaacacacctatgtaaccaaatcaagaaaagatgatttatcaggctgggcacagtggctcatgcctgtaatcccaacactttgggagaccaaggtgggtggatcacctgaggtcaagagttcgagaccagcctggccaaaatggtgaaaccccgtctctactaaaaatacaaaaattagctaggtgtagtggcacacacatgcagtcccagctactcagaaggctaaggcacaagaatcacttgaacctgggaggtggaggttgaagtgagccaagattgggccactgaactccagcccagggcaacagagtgagactccatctcaaaaaaaaaaaaaaaaaaaaatgattatcagaccaattctccttgtgcctcctcccagtcattactccataaaaggtaatcactatattgacttctaacagcataaatgttcaatattttatttttcagtagaaatcatggtaggttatataaagtaagtcaatagtaaagtcagactaacttacagaaatttacagtctctttgagatcagcctacttgaaatgtgagcttgacattctaagtaaagacttacaagcagtgctgggtctacacctctaactaagctcttggaagtctgtaaagatcttcagaccaggcagggtggcttacccctgtaattccagcactttgggaggctgaggcaagagggtcactttagtttttgcttactgagataacagaagacaagggaggattgctttaggccaggagtacaagaccagcctgggcaacatagcgagaccctgcctctatttttaaaaataataaaacaaaaaaaaattcaaaaagaaaaagacatacatccttgttccagagactgtgatttattttctttttaaattgctaaccaaagaaagctttactcctgggcaggggaggaggaagacacaaggaggatagccaatctcccattcattcggactctggtaaccacagagcggaggtaaccaaattccacaggcctcaccgctgaaattcaacagtggccagcagtagcttaatatcatggattacgcccaagtacacaacattcctttctaggatgagagaaagcgagcacagaatttatcctgttcacaaatgtggcgtaagtgaccaaagaatgataaatgttttaatcattcaaagaaagtccattataggtctataaaagtccagtgcattgcagcactcaaaatcttgccgggcgacaaaactagagattccttttctttgtttcgaaaaacaaatctcacagatgaggagacttttcaggaacatgctgggggagggaaggtacttcccgctcagatgccccttgaggcagctagtcccaattccccctgccaaccgcacagacacaccaccttgacctccctctcccttctctttcctcttattgctactcatgtgccccaggcgcccgtggtcctgacacccctgcgccgctggagacccctctaaggtaagatggctccgactacagggcctttttggcacgctcagtctcccagccccaagcgccaaaagtgcattagggagaaacgtcggcacgacgtcaagggcgcgaacaagcgtggtggcccaggtgagcgtgcgcggcagccaggcacgcccggctcccggggaaagacgccccttttttgccccggctgccaggccgctccttctcaacttgtgcgcccctggaagagcaaagagagggccctgcgtggaacctatgaagcctccttcggttcctcgctgctccggccctagagagggcgaagaaggaacagcggagcccaatccctttccgaaagccaccgccgccctccagtttctggcccgcagacgaagtggagatccagccaggtcttgagtgctgccgccccatccctgcagccggagactcacctgttgccactcaaggtaccgctacctacaacaccgccgactccgcggcctttaggatttcagctcagttcagctaaaccacgacaggcgtgggggcaggaacagcaaccaaccaatcacccaccgcctcctggagcttttgcaccaatgagctcgaagttttgtgagtgacgacatatctggccaacgcaaagaagagtaagggcctgggagggagggagcgccgtaggcgacgccatgaagctctggcaataccatgttcatcttcaaatcacagttaaacgaattctggcgagacacgcccacgtcccccacccccgatgccatgtgcgaccaatcagaaaagcaaaaggattgtctatttgcacggccaatcagctgggaaaatcgccgaggtttgagctaacctcggagcgttcacaccaaccgggaggggacatgtgggccgggccaagttaatagtgccatggaaggaaatttaccgcggttgagttaaacgtagacattagtttggggcggtgttccgcgtaggaaataccacacactgacactgaaattaggcataaggaagttttcctattccgcctgaggctagactgccctcccacctctacacagattttcaagttggggaaaatactggccacccgcacctcgttaagacgtcgcagaaccagtcctcgtttccgagaaatgctttctatagtcagttccctaaatgcccaacttgttagctaaaaaggttacaaacgcctgtaaatggtacataactgaaatcatcagaacaacaaacatctattaaacatatactatgtgccagaaactatatcaagaacttcagcaggcccggcgcggtagctcacgcctggaaggccaaggctttgagctaggagttcgagaccagcctgagcaacatggcaaaaccccatctctgcaaaaaaaaacaaatttaaaattagccgggcatggtagcggctgtagtcccagctactcgggaggctgaggcaggaggatcacttgagcccaggaggtagaggctgcagagagccgtgatcacgccactgcactccagcctgggtgacaaagcgagaccctgtctcaaaaaacacgaacaaaaaaagttagaagatactgctagaattgactaaataaataaataaataaataagaaaaacaatgttacctgcaggaccgtaacgcccagtgaattacaaactattatccctggccagacgtggtggctcacacctgtaattccagcacactgggaggccgaggcgagcagatcacctgaggttgggagttcgagaccagcctgaccaacatggagaaaccccatctctactaaaaatataaaattagccgggcgtggtggcacacgcctgtaatcccagctacttgggaggctgagacaggagaattgcctgaacctgagaggcagaggttgcagtgagccaacatcgtgccactgcactccagcctagacgataaagcaagaccctgtctcaaaaaaaaagaaagaaaagaaactattatccctgctgttttacagaaaaatattaagtagcctgggtctgtcccactcccacaccttaatctttttctttctttttccttttttttttttttttgagacagggtctcactgtcgcccaggctggagtgcagtggtgcgatctcggctcgctgcaacctttgcttcccaggttcaagtgatcctcctgcctcagcctcacaagtagctggcattacaggcatgtgccactgcgcctgcctaatttttgtatttttagtagagacagggtttcaccatgttggccaggctggtcttgaactcctggcttcaagtgatccacccacctcagcctcgcaaagtgctgggattacaggcatgagccaccgagcctggccaccttaatctttttaagcaaatacagaatggaaactgccctcacaggattaaggagagttacaagccaggctttaggcagcattatatatagttagctgttatccagggtgcacaagtgtactttgacccacttccctgcagctgctaactcactgaacatcactccacgtgctagaccacctcctacctgtttctccatggttcttaccatgagtaagaatttctgacgctagactcataagatcgttttgcccaagaacgggttgtttttcagatcctgaattctgacgtccccaaccaaggaacccactcagcacaagaatgaggtttcttggtctccctgtctcatgacttcgcccttcacttcttgaccaatcatcgatccccacactgcagcccctgtccagaggacttaaaaaccctgccccccaaacctctcagggaggtggatttgaggcttcttcccatctcctcattcagatgccctgtgattattaaactctttctttgctgcagccaggtgtctctgtatgctgactcactgtgcattgagcaaacaaaactattaaattacagtactacttactcttctaattacagtgcttatatgtatgagggttaatataaatacatatgactccttaaaaattaaagtatgttttttctgactataaaaattatacataaccgggtgcagtggctcacacctgtaatcccagcactttgggaggccgaggcgggcagatcatgaggttagatcaagaccatcatggccaacatgctgaaaccccgtctctactaaaaatacaaaaattagctgggcgtggtggtgcattcctgtaatcccagctacttgggaggctgaggcaggagaattgcttgaacccgggaggcggaggttgcagtgagccgagatagagccactgcactgggtgcagagcctgggtgacagagtgagactctgtctcaaacaacaacaacaacaacaaaaaactcatgctagtttaattttcatttatttgatgacttgctatttttccaaatgtttactagtatttttatttcatctattagaaatgatatattcatgtcctactgacttccaagggaaagatagaaagttgttttgccaggaactatgaaggttgtttgaatggagtcatcataacctaaaaaaaaggtgaaataacgaaggtgagatttttacttaccattgtttgttcctacagaaggaatgctggagctgataattatgagaatttatccttccatccctcatagcctaagaatattcattattttcccaatatctgcactgagcctgtaaaccaaaatgtatctgagacatgtctcaatcaatttacaagtttattttgccaaaattaaggatgcttacctgggagacaggcctgtgcctttttccaaaggtgattttgagggatttagtttggtttgtttgtttgtttttgagccagagtctcactctgttgcccagggtggagtgcagtggtacaatcttggctcgctgcaacctccacctcccaggttcaaatgattctcatgcctcagcctcccaagtagctgggattaacaggcgcgtgccaccacttctggctaatttttgtgtttttagtagagacggggtttcaccatgttagctaggttggtctccaactcctgacctcaggtgatccgcccacctcagcctcccaaagtgctgagattacaggtgtgagtcaccgcgcccggccagaaggatttaagattttatttatttatttatttatttatttttatttttgagacagagtcttgctctgtcacccaggctggagtgcggtggcacaacctcggctcactgcaacctccgcctcctgggttcaagccattctcctggctcagccgccccagtagctgggattacaggcgcacaccaccatgcccagctaatttttgttgtttttagtagagacggggtttcaccatgttggccaggctcgtctcgaactcctgaccttatgatccacctacctcggcctcccaaagtgctgggattacaggcgtgagccacggtgcccagcaaggatttaatatttaaaatggaaaagcaggctggaagggaaagaaggagagtatggtcacattactgaattcacatgttgcaagagacaaggagcaagtaggggaatagtcaattatgtattactctcgtgcttaccataagataaggtggacatagagtagttagctgcagtcagtcctgcttaggaatgaaaggaaaggcaacttcttgcatgactcagctttcagcttaaatttttttcttttggcagaatgaattgggttcccaagtttttattttcctttcacaagcctctgaataaacaaagttcctgcccacatggcattcaattgctaaacaattataatcacataaatacatacacatatacgtatatgttttatatatatatatatatataatatatatttaatacatacgtccgggtgcagtggctcacacctgtaatcctagcactttgggaggctgagttgggtagactgcttgagccaaggagttcaagcccagcctggtcaacatggtgagaccccatctctacaaaaaatacaaaatacaaaaattagctggtcatggtggtgtgcacctgtagccccagctactcagaagactgagatgagaggactgcttgagcctggaaggcagaggttgcagtgagccaagatagtgccactgcactccagcctaggagacaaagtgagactctgtctcaaaaaacaaacaaacaaaatacattcatatagagagagaaaaagagggagaattttataatgatatgcatgaggaatgtataggggaagaggctaaaaataggccgaacttactagtgaatatattcaggaggtaggactgtgattgtttttaagtgatcgagggaaaatagtgtactgattttaaaatggaaaactcaacttattttttaaaaattaaaactctgacaagagggaggtttaattgaaatcacagtggctgctcagggaagtttataaatctcgaactgcaacgactcaataagcatgaattgcttgtgatgatattgacttaatagagttattttttccttaatagaaaacacatcttatcaatataatgttatttgtaaagcatggaaaggacaaagtgctcttgggagaagtagaaagagaatttcactctgagaaacctatttggagaaagctcctcatctctggcttagactttaaaattagttaatagtgtaattagggatagttgtagtaatagtggtattggtatggtagttagagtttaaatgtcacacagaatacccagaccaccttcccccaagtgccactaaacttattcttctaatcaaacctctgctcaagggatgtcttcttcctctcttggaaagctgtgttccttacctcagaaacagccctccataaacctgcccttaagagaatccttggccaggcacagtgattcacgcttgtaatcccagcactttgggaggccaaggcgggtggatctcttgaggtcaggagttcgagagctgtctggccatcatggtgaaaccctgtctctaccaaaaaataaacattaaaaataaaaaaattagccaggtatggtggtgcgtgcgtgtaaatctcaactacttgagaggctgaagcaggagaattgcttgaacctgggaggcagaggttgcagtgagctgagatcgttccactgcactccagcctgggcaacagagcaagactccatctcgaaaaaaaaaaaaaaagagagagagagagaatccttaagacatgccttcttggatgccctctggagaaatgtcaagagtagccaatatagtcaccccagtcggctgtggtgtgtgggcctctagtgttttaaggttctaggcaacttagcccctcccaggagatgctgatttacttttctcaaggtgcataaagtctcatcacaccaatatctgaaaaatctcttttcaaagagatgcaggcagccttccagccccatgatgttaatacacagggttaggcagcctggcaagtgcactggggcccccactgaaggatcatctggtttccatagcaacagtccttcctttccacggaggattctatcatctctcctgctcactcaggctttccagaatgaattgttttttgtgactataggtgtttgtccttgatcctgcaaagagaaaagacatattcatttaaaacaaacaccccccaccccgccccgcaactgactgcagctagaatactgcattgcatcagctggtcttcctttcatttaaaaattccatgtcctttctccattttgctccgttctctagctttatccatcattttagaaaacaggtttctctgacagaaaacaaacagatggcaactccatcatcctaaaactggctgtgacggggctctaaaattaagtgttcatggggctcccagaaagcctaggcttgcatggtatgtgtggctgacctgtgagttacgattggaggggcaagagaaggctttctatacacagatggctccccatacagtgtcacagtctctgaagtgttgccttttgaggtttgttttcttaggtcaggcactgctgtcctgtcagtattttcctaaattgccaatactcctgggaagagtaatacgttaggttactaatactgaaagaacttgggaaagagaggagggggtgcagcgggaagggaataaaaggggctctgaagaccacctttgtgtgcttcacagtgacatcttctgcaagaggggaagtgcaggtcttcatctctctctttgtctctctctgtcacacacacacacacacacacacacacactgcaggacgccttctgacaattacaatacagtagtgaattcaccgaacaggactgttccctgaaacacctacatacaatcccgctggaagacctttgaaacagccctgcagtgactaaaaactctgtccccagtgccacttgtttaaccctacagtttccacagactaaaggtagttttcctttggttaatatgaaaacaccaaatagtcagattgctttgttaaataaagtggattacggtgaatctgttcacttctatgttttatattgccctcactccacaaatcacagaagatatttatttttcccccagttaaattctgttaccacaaccattacaaacaaatgtctatataaccaaaatgttagtcagccccattccaatggagcacattttaagtgatgtttaatgggacataatttgaacataaaattctatctgtgcactgttttcaagtctttgaatcaggcctccacctatagatgttggttacctatcagggagcaacaggtgatgctaaggatcactttgtaaaaaccaggaatcacatccctgtaactgacaggaaactgactatattcatcagggttctccagaaaaatagaactaacagaatgtgtatatacataggaggaaattttgtttaaggaattgactcgtgtgatcgtggagactttgggagcccaaaatctgatgggagaagctggcatgcaggaggcccagggaagagttacagttctagtccacaggtaacctgctagagaattccttcttgttctggatgagtttggccttttgtctattcaggctttcaagtgattggatgaggcccacctacattatggagggcaaccttctttactcaaagtctacagatttaaatgtaaatctcatccaaaaacaccctcacagaaacatccagaataatatttgatcaagtatctgggcaacatggccaagccaagttgacacagaattaaccgtcacactggatcacaagggctgtgttcagcaagaactgaccttggtcaaaccctgcccctgcccttatgccccactcttcttcattctgggtcctgctatttccattttatcatgtcttcatcttctttccccacctttcaggtacctttcctctctgaccctatccctagactcacctcctaccccccactcaaagcccttccttccttaaaaaatgatgttagtcattacactttaggatttaaattaatcattctgttagccgtcttactaactttctcactgtgaaaggaaagcatattaaaagaatttcagggatcgacgaagagctgagggaggtatttttctaggaagagaaagtgactaacagaaatcaagacaaagggggacaatcagatttttcagatgacagaaagcaggtaaactctagagatctagagaactagcaaatggtctcttcagggtgtcatcattgcagtaaatgagctctagctatttctgtctttattcttcagggtattcaagattgcagttacttaggagagacagagcatctgactgattgaacttgggttctgtattcactcctgggccagggggaggcagggtacctggtctgacagtccttccaaggctgcatgaaccagaggagctgttaccagaaaagggcagagtgaatttggggcagcaaaaacatttattgcttatcgactatcactgcaaggattactcagagggtgatgcagaatcagcacccctctatttctaagatgaccttgaatgtcagagcaaggcacaaacaggttgcagagacatgtggagtatctggagcactgtctcaggatccttcctctcctgctggatgctaaggaccttaaggacaagagctatctttgcttgcaatttatttggcaggccctgcagggctgtgcaaatgattctatttaatttttactacttgtgagaaggcacagagggctttgagagggcacagagggcctcttataatgggtagatatgcacattagctgatacactggaaactttccagcaggcatatccttccaagatgataaatattcttccttgttggagaaattgaagacatttgtacttgcaatctagcttatctagtaaaacaagacaaactaaccagtgatagggagaaacatgtttgcattattttccaaccttgaaaataatgtcagattattggactgagaaccaatgtcatcttctggatctggtaattatttggacaaaatctctttgattctaggttcaaagtcaaggtgtcaaaaaaaaaaaaaaggatacaactgttaagcttatttaattatacctctcactgtacaaataaggaaactaggccaggcgtggtggctcacttctgtaatcccagcactttgggaggacaaggccagtggatcacctgaggtcaagagttcgagaccagcctggacaacatggcaaaaccctgtctctactaaaaatacaaaaattagctgggtgtggtggcaggcgcctgtaataccagcgacttgggaggctgagacaggagaatagctagaacccgggaggcggaggttgcagtgagccgagatcatgccactgtgctccagcctgggtgacagagtaagactgcgtctcaaaaacaaacaaacaaaaacaaataaggaaactgggctcagagagatgaaggtacacaggtgatgggtagatagggacaaagaaaagaacctaaccctttggactccccaagccattctaatatttgtttttgtaagttagtagcttctgcacgttagtatgtcagaactcaactagtttcctatctttcctgataacctctccgacccacccatgatttagctaacatctgatttggtcaaccaagcaccctggtcctcaggttcagtgtgagacttaatgaaataggcgtgaatttttttttttttttttttttttttagacggagtctcgctctgttgcccagcctcgcaatctcaactcacttcaacctctgcctccggggttcaagcgattctcccacctcagcctcctgagtagctgagatcacaggcgcccgccaccacgcccggctaatttttgtatttttagtagagacggggtttcactatattggccaggccggtctggaactcctgaccttaggtgatccacccaaagtgcttggattacaggcatgagccaccgcgcctggctggcatgaattttttcttctgtccctagttcatcttcaggtcactgtctgattttattagttctcaaatttaaatcactatgcatgctcagctcttctagttatttcccttctttcctcatgttgggaaaaaaaccccgatttattctaattgtgagaaatgaaagcgaacaaatcctatcattccctattgtcttgtgcaaatatgaagagagatatgatagtggggtaaataaaagcatcagggaatccattcggcagaatctttctcctctcagcgtgcttgcagttagatattctgagattccagtggagaaatggtatggtggaaacattgaggttcaacaaggctcaatttagggcatattttattcagattctaccatatatattgtctaaaatgaaacaacactggggaatgaaaaggttggtcgaagatgcaagttgcctttattaaataaagacaaatatttaataaaaataatgtataaaaataatcacaattcactttcaaatctgaaaatactgagttttccaggctacacataaataaaactgccaacgatgacaattccagcaactaggaaaacaagtacgcctacaaagaaaagtgagaaaattcatggagaatttgaactcagaaccaactcctcggagctgatcttttttgggggaagccagggaacgcgccgggcgctctcatcagcaagaccatgtttaaagagagtgtggaagcacagaccaaaatggacattcgagggcgaacagcagctggcaaagggataagtgatccgaagcattaaagcccttgagacaaattccggcgcgaaccgccagtgggggatgagactcgcaggcgcagccctccaggccccggcggactgacacgcacgttggaaacggagtcacccaccacagccccgcagctccagccaaaatggcgccgccgctctgcccaccccgcgcaccccaggcggccgccgagcccgcgcgcgcgccctgtggagcgaggacgccggggacgcggccagggacgcgcgcgtcctcacggcggttgcacgcctgcgcgagggcgggcggcgggggcgcgcgcgcggcgggggcgggctttgccgagcgcagagctgcagccgccgagccggacgtgtccgcgaagatggcgggccgggtgagtgccggtctgggagcccaggcttgaggcaggggcgccgggctcgcgggcactctggggtccaggcggccccagaggagtgggagtgaatccgagcaatggggcgcgaggccagagcgggacttgagggtagcaggggagcggtggcaggggattagccctcctcaacaactccacccccctcgaggggagatgacccctcgttacacgcgtctgctgcgcctcccgtcatcctcccttcccatcccttggggcttgttccctcgtcctccacacagccgcagggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaaggtcgttgggaaagaggagggggtgccaatgacttttagtgttaaagcccggccatctgggggacctgtcaactgtcgggtcaggcaggaattggctttagcttggagtgaggatggatttggggtgtcacgttttgtttttatggatgacactcgcttcgaatgcagcaggatatgctgtagtttcagggttttaaatttacttcctcctttagcctttaggatcgttgggtaggatgggtttggcgaggagagagagctggttgagtgctgtattgcagtctgccttgagctaaaagctctcaagggatgagtcctgcccggagattacactggtcataaacctgaggacattaactgcgtcattgggggtgaaagatgtgattgactgatctatttataacagaatttttgaataagtttgcatagatttatgcatatatgcaaatgccctatctgaagggacttgtaggtcatgagattctagagtaagaagggatcttaaaggtcatttagtttggcttctttctcttccttttccccatggcctctccttttaaggctagtccttctgccagtacttcagaccctatctgtatattcacctgctccttcttaacataatcaagcttctctatcttaaacccttcccccacccccacagctgtcaccttttcccgtcccagtttacagcaggaaatttgatagagttgtctatatttattgtcttccatttgcttaccacctactcacccttcaacctactgcagtctgatttctgccccatcatcccactgaaacctgtccctcaacttaattgatacctttcaatccttatcttatttgatatctcagcagcgtttgacgttgttgaccatggcttccttgacggaaagcactcttcacatgtgttctggaatgcctcgctcctggtttgactcagacctctcttttgcggcctcaccctcctctactttgttattcattgctggtattcctcaaaggccgtcttctcactctcaatttcccgctcaggcaatttcttctaagcccatagctacaactgtctatatgccagtgattctcaatattttacccccagtccagacctgccctttaagtttcaggttaatatgtccaactgcttatttaaaatcaaggtcccgaaacgcagctttttcaactccgaacccaggatcttagcccacctaacttgtgtagatactcctcgacttaacgatggggctaccttccgataaacccattgtaagctgaaagtatcagaagttgaaaatgcatttaatacacccgatctaccgaatatcatagcttagcctagcctgccttccttacacatgcacagaacacttacattagcctacagttgggcaaaatcatctaacataaacctatattataaaatgttgaatacctcatgtcatttattactgtgctgatagtgaaaaacagaatggttgtgtaggtcttcaaagtacagtttctgctgaatgcctatcacctttgcactattgtaaagttgaaaaatgttaagtcaaaccattgtaagtcagggaccatctgtacctatccagtgagataggaatatctcactgaatgataccatcatccacccagttatataggctgggaatctgagggagggagagggtgggtaaccctttatgtctctcttttgctgtacccatgtcctctgccctatcccccggtaaaatttgtcagagttctgctcctgccccccataaaggtatttaattagggccaaagactctggtttgggggaatggttgctttagactagttccaagtcacccactggactatctggattggtcacatgggttctgtcattttaacctaaaaatctccagtctgtccacctttccacatcttcatttttacctccttttcccaaactaccatcatttctggtctggactactgcaggaagcttccaagtatttttttgttcgtttgtttgagatggagtttcgctcttgttacccaggctagagtgcaatggcgtgatccctgctcactgcaacttccgcctcctgggttcaagccattttcctgcctcagcctcctgagtaactgggattacaggcgcccaccaccacacccggctaatttttgtatttctagtagagacggggttttaccatgttggccaggctggtctcgaactcctgacctcaggtcatccacctgccttggcctcccaaagtgctgagattcgtgcccggcctcccaagtagtcttcttagagcatgtggcccacctccaattcattcttgaccttcattgttccttcccgtgcctattactacttaaacccctcctcagcagcatcccattacttttgggagaaaaccaaatccttaatgaggccttcaggactctttgtggttctgctcctgcttctttccactcattctcttactctgtgtgctcaggttatatggtaaacgagcctttcaattccttgaacctgtagtttctcttaccacaaggtctttgcgagtggtgtttcctttctttgtaacgttcttccccccaaccatttacctcctactcagacatcacttagctactcaagggaggcctactctgaccccacattataagtcaggatcctttgttatatactcttgaagaactgtattcctctccttagagatttatctttttgttactttgagtgtgtgttattatttgcttctaccacttcacctcagtgaaaagcagagaacatacaagttatttagtcattatcaactgcgctttgtgtaccttgtgggacttaggtactcaatacatttttgttgaaaatgaatcagtctctgaacactctggtgatagatggtatattaccctaaagcttgcctgtaatgtcatacagctatgttaggtctttgttatctggagttccatgtaacttttatacgtagttactatttctgctgtttcaagccatacggaactaaacacaattctttttccatgtaatagctactcaagctactcatttacttgaatacaggttacatatctcctcagattttcgattttgcaagttaaacatcccccaattcctagcatatttcatattccaaacccttcatcatttaggctaccttcctctggaagtaacctaatgttactgttttgtcaacctttcttctaaaatgtgcccagagtggaacacagtgatcagagaagaatgtacttaagctattattgtcttgagatggacactaccattattcataccagataaaattgtattagcgttttttctatagtaaatcacattcttggctcatactgagcttgtagtcagtgaaaactcatgttcttttaaaatcagctccctagctccattctaggtttagagcagttttattgaacctaaatcaagaccttatccttttacaattcatttttttaggtcagtgcatgtctgctgtttgttgaggtaatctggattcttagttctttcatgttaggaaacataatagctgtctcttccagtttggttagatctgtaggtttaatcatgacttctgtttctacgtttgagttattggtaaaggatagaataagacagggtcagaaataacccttggacatgctgccagtgacatgcctctagactgatacccattaatacacttgggcactgttgcttaaatacagatgtgtctcatttaattccaacaaaacaacctgcaaagtaggtagtattatctttgtttttttgcagagagaaagagagagagatttagtaacttgagaagttcacatagccagcaagaagcagggtcaagatttgaactcagatcagcctggtactgttacctagttcaccagcttagttgcaagagtgtagtaaagactaggtttacctcacctagaactttttggacataataatgttcagaaactatcttctaccttttggaaaatctgaaaaactttggcccatctgattgtctatcatttcttctgatagcctttattttctagtaactactgagtgatttttagcaaaaatagttcaccttgttgcaatacttttatttgtgcatatttatggagtacatgaaaatttttttacatgtgtataatgtgtagtgatcaagtcagggtacatgagtccaatgtattaagtatagtcatctactcagctatcaaacattgaatttattcctcctatcactggatcttttttttttttttttgagacggagtcttgctccgtcacccaggctggagtgcagtggtgttatcttggcctcactgcaacctctgcctcccgggttcaagcgattctcccgcctcagcctcctgagtagctaggattacaggcatgtgccaccacgcccagctaatttttgtatttttagtagagacagggttttaccacattggtcaggatggtcttggactcctgacctggtgatccacccgccttggcctcccaaagtgctgagattacaagtatgagccaccgcgactgacctcattggatctttttaccttttaacccacttctcttcagcctttctctcccttactccgccttcccagtctctgttatctatttttccactccctgcctccttgtgttcaaattttgtagctcctacatatatgtgaaagcatgcaatatttgtctttttgtgcctggcttatttcacttaagagaataacctccagttccatccacattgctgcaaatgatatgatttcattctttttatggctgaatagtattccattgtgtacatgtatgacatcttctttatccattcatctgtagatggacacttaggtggttgattccatatttttgctattgtgatagtactgcaataaacatgcaagtgcagctatccctttgatacattgatttcttttcctttgtgtagatacccagtagtgggattgctggatggaaggtaattctatttttagctttgagaaatctccatacagtgttccttagtggttgtactagtttacattcccaccgacagtgtatgtgagagttcccttttctctgcatccttactaacatctgttactttttgtctttttaataatagccattctgactggggtaagatgatatctcattgtggttttgatgtgcatttctctgatagtggtgtggaacatttttccatgtcttcttttggccattgtatgtcttcttttttaatgggattatttgttattttccttttgagttgttcgagttccttgtatgttctggatatcagtcctctgcttgatgaatactttgcaaatattttctcccattcaacaggttgtctcttcattctgttgattattcttttgctgtgcagaagctttttagtttgcttaagtcccatttgtttagttttctttatgttacctgggcttttgatgtcttaatcataaattctttgcttacaccaatgtccaggagtgttttccctagactttcttgtagtatttttatagttttgggtcttaaaatcttcaatccattttgagttgatttttgtatatggtgagagataggggtctagtttcacacttctgcatgaagttatgcaattttcccagcatcatttattgaagacagtgtcctttccttagtgtgagttcttgtcagtgttgttgaagatcatttgtctataattatgtggttttatttctggattctctattctgttccattggtctacatgtctatttttataccaataccatgctgttttggttactatagctttataatatattttgaagtcagataatgtgatgtctgcagctttgttctttttgcccaggtttggtttggttgtttgggcttttttctttttccttttttggtcccatatgaatcacattggtattttgatagggatttcattgaatctgtagattgctttggcaatatggtcattttagtgatattaattctttccacaagcataggatgttttttgatttattttctttcattggtgttttgtagttttctttgtagagatctttcacctccttagttaaatgtattcctaggtttttgtttgttttcggtagctattgtaaatgggattgccttcttaatttctttcttggctagatccttattgatgtatagaaatgctactgatttaaaggttttctaaacctacagatatataatcagcaaagagacaatttgactttctcttgtccagtttggatgcctttcatttctttctcttgtctgattgttctggctaggatttccagtactgtggtgaataggagtggtgaaaatgggcatccctgcctcattccagcttttagaagaaagatctcacctctcctcattcagtatgatgttagctctgggtttgttgtgtatagactttattattttgagatatattccttctatgcctaatttgttgagagtttttttaatcatgaagggatgttgaattttatcaaatgtttttgttgttgttgcaatactcttttttttttttttttttttttttttttgagacagagtcttgttctgttgcccaggctgtagtgcagtggcgcgatcttggctcactgcaacctccactcactgggttcaagcaattctcctgcctcagcatccctagtagctgggattacaggcctgtgctaccacacccagctaatttttctatttttagtagagacagggttttgctatgttggccaggctggtctcgaactcctgacctcaagtgatttgcctgccttggcctaccaaagtgctgggattacaggcgtgaggcactgagcccggctgttgcgatactcttaatgggttttatatttcctttttgtgggggacagtttattttgcattcttactacttttgatattctgacatcatcttataagtgggatttatattcactatgtaattgaagttttttccaatgaagcaccgtatatagtttatctgggaaattggctgaagaataaaatgtgtgatgttattcagtgtacagtttctaggtcatcagaagataccactaccttcccactactggaaaagaaaaaagaaaagttttccacagtgcctgaactgttttgtatgcttatcttttaaaattgccagaaatctcacttactggagattcagcagtccctttctgaaaatacacatactttagtgcaaataaagccagtggatctctttcttcataagtccttaaacctagtcgaggtcatctgtttggcagagataggagtaagataatgtgaaataggaaccaacgagagagaacttgcttaggagttgaaaggggtatggaaagatgttagaggtaaaatttgtcgaatctagtgttttgactagggcaggccagaatattcagtatcagtatcaatatcagaagcttttgtagcctttgtttagaaacctagtcatttataacattttgtgggtgaatgacatcattaccaaacaaactttcagatgaaactttggaactcaagctgtaaattgtggatagctcatgtgcagtactacaaatcaaaacaaatactataaagtgtttggtagtccatttcctgaatgaaagtttgtccaaagtatatcaactttctgcagtcttacatgcagtagttattagttttgtgtatcgctttagtggatatttttaaaagtatcttcaaatgcaatgaattttaggaaacaaaacaattctttaaagcatcattagatagcttcttctttctgaaacccagaggaatttatgtataggatgactctttttttcaagtagttaagttaaggtgcaaaagtataaggtaaagtatattatcttaccattgaaaattttggcagtggcagaagagcgaacccttacaaataccttcattgggcaatacactaagcacttgctgtaatgctttttaaaacatctatactctggctgtggtattttaagtgaaaatctctcagtgagatactctttcgtattttagtactgatatccttaatattgctctgagagctaccttatactgacttcagtttcctagtgatttaaactactaatttccaacttatttttttttatagtgaaaactaaatattccttttgtagatgtaaccatttctggaagccctaagtatttttgaatgagtataattcatgcacactttaagagatttcaagcatgacaagcacagtgaataacatatatccatgtgattaccactgaggtttaagaaatgttaacatatgatatctgcttcagatatttatctttttaaaaatagaacattacagctgggcatggtggctcacacttgtaatcccagcactttgggaggctgaggctggtggatcacctgaggtcgggagttcgagaccagcctggctgacatggagaaaccccgtctctactaaaaatacaaaattagccgggcatggtggcacatgcctgtaatcccagctactcgagaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctcctttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgtgtgtctttaaaatgtatataatggttttatgctatatctttctttctgcaacctgcatttttcacttaaaataattttgaaatttagtcctgtggatatatagtgagccaattaattctgcttagctactctgtagtctgttttgtgaatataccacaatcatctactttcttattagaggacaatttaggcagttccaattttatttttcccggaatgtacattattttagtcgagtgccattgccacattagcgatattttggttagtgagggactgcagataggaaggtgatcccaaaagattataatgccatatatttactctacctttctatatttacatatgtttagttacacaattacccattatgttacagttgcttacagcatttggtgctgtaacatgctgtacaggtttgtagcctaggagcaataggctataccatataggtttgtgtaagtacgctctatgatattcatataacgatgaaatcacctagtgacacatttctcagaatgtatccctattgttaagcaacacatgagtgtgtgtctccatgcatatatgtgtaagagttagcatgtgtgtccagaggtagaattgctgggcgataagtcatactcatctttacctagttatgccagtttatactgtcactagcagtatatgagtacctgttatttatatcctctccaacacttaatattgctgacattttaacttttacaatataataggtgtaaaactattgtttaaatttgcatgttgtcctcattactagtgagattaagcatttttcatattggtcattgggatttccccttctgtgaattacttttgtatatttgctcattttttctgttgggctgtgtatttttttagtgatttgtataatttttcgttttttggggggtagggtatgctttggattctaatcctttgttgtaaatagcttctctcagacagtgatggtcttttcatgatgtttatagagtgttggatttaaattttatagttataattaccctttttttttttttaccttggtgatttgtgcttttatgtgtttttcaggaaatctttctccaccctgaagtcattttcttataaaagttttaaaattttgccttgcacattttggtgattgatcaggaatttatttttgtgtttggtgtgaattatgaactaattttatcttttccatatgtataaccagttgtctcaatatcatttattgagtccatttttttcctttactgatttgcaatgctatctctgtattatatccagttcccatatatgtgtgggtctaagtgtcgactctattccgtttcataattctttttgtccatatttgcatcaataacactgttttaattgctgtagctttaaaattattcttgttatttcatagggcgtactttcattacctttcttaatttggcatttcttggctcttttccgtatgaattctgggaacaacttaatccccactcctttaaaaaaaaaaaaaaagacactttggcctggcatggtggctcacacctgtaatcctagcactttgggaggctgaggcgggtggatcacttgaagccaggagttcaaggccagcctggacaacatggcaaaaccctgtctctaccaaaaattagcgggcatggtggcacacgcctgtaattccagctacttgggaggctgaggcatgagaatcagcttgaacccaagaggtggaggttgcagtgagttgagatcgtgccactgcactccagcctgggcaacagaacgagacagttttttgtttgtttgttttaaagacacttttaaccttccgctatggatttttgacctacatttttcctcttgtattttataagagtagacacagagagcacttcaataaaattcagctcaataactttattaacctgatctccttttctttgactttaagctgaaagtgttaatttctcacaacttgtgctctatagatttgaaaccaaatcaattagcatcagctgtttatgagtaatgcagggtattttggtcttttgctaaattcagaaagaaatgttaaagtgctgatggatttgcactagctgtatagatctttggtggaggaggaaatgggaaaattattaatttcaggtaagaagtcatttttgaaatgcaagattcatttctttttaaaatcaccacataataaaaactttaagggctgcattggtgggtttttaaaaaaaattgtgaagtgtttttagtgttatgtgctgacaaatatttttgtagttgctttgacaagcaatgaaactaccaattatcactaattctgagtcttccaatgaacctctgtgtcaaatttttaaatttaattatcctgactatttttctcctagagaataatattgatataattttgtgaaccatagcagacagttcccattgctgagaatagagcctggtgtggggatattatgattcttgaatggttgaacaagacatttgcttctgaacatcttagtaaattatcacttctgacaatgtctgtagtttgaattttgatattctctgccaaggtattgaatactctaaataatgttgtttattctattatttaaatcattagtattatagatctagctttaaacagctgctgcactccagtcctttttcttcacctgcagatattgagtctgataactgttttgtatacatagcctttcagtaaatctacttatcagtcatcaaattaacttaattataagttaaatgatgagatggaccaagagtgttattgaaatctcatttccacacatttcttctcttcttttgtagaaggtaatgaaatgaacctgtcagtgttcctgtttttatgaagtttatttctcttagtacagtgattctgatagtgggttctgcagaccagcaaattagcattatctgagaacttgttagaaaagcaaattctcagttcccacttcaggctgactaatttagaaaccctggggtagggcttagcattctctttcaataaattctccaggtgattctgatgtatgttaaagttgagaagcattcacttagtgttttgagctctccaatttagttccttataaattgttgaagatattttttccagatttctttccaaatatgtgctcaaccttgttactgataggtttcaaggttatcgtcttcttcccattaataccttcatctatatccaattttcaaacttttaagaaagcatggctattttgctgcagtatggtgaattaggtactctgactgaccttcccagataaacaatttaaaattctagataatttttttttggagggaggacagggtcttgctctgtcacacaggccggagtgcagtagtgtgaacatggctgactgcagcctcgacctgttgggctcaagcgatcctcccacctcaacctcccgagtagctggggccacaggtgcacaccaccatgtccagcaaatttttttattttttgtgcagatggggtcttgccttgttgcacagactggtctcgaactcctgggctcaagcagtttttccacctgggcctctcgaagtgctgggattacaggtgtgagtgactgtgcctggcagatgaaatattttttaagtaaaaaccttatgtgcatggagatagctggctgaaaagtaaggaataatcaggccaaaaactatgtgaaggtgaaaacccagagatataagccaagtactgctgccttgaggacattatttgcaaatgacattacttggaaaacctagttaacttgtgcttgtgcctcaagaagctcagagaacggaagataaaagtagttttctggtagaacgtcccacctctcctggtaaagatggtaccccaagggtctatacatcataataaatgagaactagtaataaacgtaccttgtctaaggatcggaaagaaaaatttcctgcctcaaactttggtggtgatgggaagggtacagaaattccctgagaagttttacccacaagctgaccttcatgcaggtttgaatcctgattttatattacctggatggtatgaaaatcttaagccagtaattaaatataaaagtggtacaagagtgacgatgccttaaaatgcctaagaatgcctaaaaagcagcaaatacaaagcttcttgggagaacccatcttgatcttaggatttagaaaattcctaaacataaagctgtaagaaatatgaactcacattcacaaaatgcagaaagaaataagatgcaatgaatgagaggaagcagaaacaataaagagcagaatcagaacctgcaaagagttcacatattggagttagcagacacagattataagtacatatatttaatatgcttatagaaaaaaagaaatttaaaataggaatgaggagcaagtatacaaaaatgaccagtgtacaaatttaataacagattagacacagctaaagaaagatttagtaaagtggatctgaaaaaattgcagtatagaggcaagaaaatgaaaagtaataaaagagttaagagaatacagagggtagaataagaaggttcagtctagtcagaattctggggcaggggagcaggggcatggaaaagaatgaggcagaggcagtatttgaagagataatgacagagaactgatgaaaaacaacctacaaatttaggaagctaaagaatcccagaaaggataaaaagaaaaaaaattcacacataaacattttttaaagaaactacatgataccatagagaggtcttaaaagctgtcagaggctgggcatggtggctcacgcctgtaatcccagcactttgggagcccgaggagggtggatcacctgaggtcaggagttcaagaccagcctcaacgtggagaaaccctgtctctactgaaaatacaaaattagccgggcgtggtggtgcatgcctgtaatcccagctactcaggaggctgaggcaggagaattgcttgaacctgggaggtggaggttgcagtgagccgagatcgtgccattgcatgccagcctgggcaacaagagcaaaactccatctcaaaaaaaaaaaaaaagctgtcagagaaaaaagatattaccttcaacaagtatttggctgtcagctgttttcctgtctataataatgaaagccataagacagggagtaatattttccatatgcttagagaaaataattgtcaaccaagaattgtatatcttgtgaagaatgggggcaaaattagacactttaaaacagacaaacactcaatgttgtaaccatcaaaccttccctactagtggaaattcagatcaatttcctgaaggctaaaaaaaaaaaaaaaaagtgaccactgatgtaaagtctgagatttaagaaggattgaagagtaaagaataatggtaaatctgtggatatattgaaataaatattggctttataaaatgatgtatgcggaggttttaaaaatagaactaaataggccaggtgtggtggctcacgcctgtaatcccagcactttgggaggctgaggtgggcggatcacctgaggttatgagttggagatcagcctgaccaacatggagaaacctcgtctctactaaaaatacaaaaaaaaaaaaaaaaaaaaaaaaaaaaaaaaaattagccgggtgtggtggcgcatgcctgtaatcccagctactcaggaggctgaggtaggagaattgcttgaacctgggaggcagaggttgcagtgagccgaaatcacgccattgcactccagcctgggcaacaagagcaaaactccgtctcaaaaaaaaaaaaaagaactaaatatatgataacaacatccaaatcaaaagagtggttaaagtattttatgatctttatactgttgaagagaaaggtaaagctattcaattaactttagattttgataggtatgtgtattagtattttcagagtaactactaaaataatataaatattaggaataatttatagcagaaaaaacaatttttaaaaggcaaggaagaagtgaaaaacatagaaaaggtcagataaagaggaaacaataaaatatagaaatcaaatcaaatatatggtagactaaatgcttcattcagacaaagaatgtcagattggattatttaaaagcaagcaggccgggtgcagtggctcacgcctgtaatccgagcactttgagaggctgagacgggtggatcacttgagatcaggagttcgagaccaccctggccaacacggccagctggccatggccagctaatacaaaaattagctgggtgtggtggtgcacacctgtaatcccaggtacttgggaaggtgaggcaggagaatcacttgaacccaggaggcggagattgccgtaagccaagatcatgccaccgtactccagcctgggcaacagggtgagactctgtttcaaaaataaataaataaataaataaataaaagcaagcaaacaaacttactgaaacaacacaaaatccagctataattttcaagagagatagctaatacatatgaatgtagaaagatagaaagcaaaaggatggaaaaagtctatcaggcaaactctaaccaaaagggaggtaaactaactatattagcatcagacaatatgatctttcagacaaaagagacagctagagataggtccctcaacaatgagaaaaggtttatttatccataaaggtaaaaacaattccaaacttgtgtgaacctaataattgcctcaatatacaaagaacaaaatgacacaattataagatgaaatagacaaatctaccatggtgaggagtttcaaaactccctaattgaaaaattaaaaagacaaaatggttacagctgaaaattaaaattaaaaattcattttctcggttgcaatagccatttttcaagggcttactagtgacatgtgacaatggctgctgtattggacagcacagaaagtacttttgcactgcattaatttagaagacttaatataattaacaatattaataattgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaaaaaagtgattaattggatttcatcaaaagacactgacttagtttgcttaggctgccataacacaatactatagacttggtggcttaaacaaaataaatgtattttctcacggttctggaagctggaagtttgggaccggggtgccagtatgactgcgttttggtgagcactgtcttcgtgacttgcacacaggcttcttgccacgtgtctgtgtggcggagagacagcaagatctcaccatctctcttccttttcttataaggccacagtcttgtcagattagggcccttcgcttatgacctaatttagcctcaattatctcccaaagtccctatctccaaaatagttggggtgggggaagtgccttgactaatgaattttgttgggggcagtggggagtgcacatttcactccatagtagacaccattgaggagaaagaccagagtggaagaaggtatttgaaatacatgtatttgacagccaggcacggtggcccacacctgtaatcccagcactttgggaggccgagctgggcggatcacgaggtcaggagatcgagaccatcctggctaacacagtgaaaccccgtctctactaaaaatacaaaaaattagccaggcgtggtggcgggtgcctgtagtcctagctacttgggaggctgaggcaggagaatggtgtgaacccaggaggcggagcttgcagtgagccgagattgcgtcactgcactccagcctgggcgacagagcaagactctgtctcaaaaaaagaaaagaaaaaaagaaatacatgtatttgacaaggacttgtacctggaatatataaagaactacaaatcaagaataaaaagaaaggacagaaagccaatggaaaaatgaacaaaggattcaaacagggatttcacaaagaacttacctgtaacgtatgttaaatgctcaacctcattagtcatcagagaaatacaagttaaaacctcagggagatattactacacacccaccagaaagttaaattaagaacacatttgtcatgacaattctgggtttgattttgttttgttttttgagatggagtcttgctcttgtcgcccaggctggagtgcagtggcataatcccagcttgttgcaacctctgcctcctgggttcaagtgattctcctgcctcatcctcccgagtagctgggattatgggcacccaccaccacgcctggctaatttttgtattttagtagagatggggttttgccatgttggccaggctagtcttgaactcctgatctcaagcgatccacctgccttggcctcccaaagtgctgggattacaggcatgagcccgcgcacctggcctgtcatgacaattctaagtggtgatgaggatgtgcagcagctggaactgatgaaaatgcatgagcacaacctctttggaaaactagcagaattccctaaaactgaatgtaggcatgatgcccatgacccagcacttatagtcctgggggtgggaggagtgaatatatttctattcatgatttctatctctgatgacagaaattaagctagtgggtatctgtggttgagtagaaggatagtgactaggagcgggcagtatgggatgctggtaatgtcctcttgacctaactgttggttaccctgggtgtgttcacttgtagaaattcattgagccaaacacgtacaatgtatgcatttttgtgtatatatgttcttcttcaataaaaacttgatttaaataatgttctttttcttaaactgggtagtaggtttatggtgttttatgtgttgcctgtgttttatacatattttattcctgttcagtgtccaaaaaatataaaaagtagtcactgctttgttgttaatttgagcatctcctgcacctagcacagtgcctgggacattatagatatttattaaatatttgttctatggaaaagaagtaggctagtaatttctttttgctttccaacagccagtttttgattcaattatttgtaaatatgatttctactcagttgtttctaaataataaaatatgtaaatactattatgtttatatttattagtaagctgaatttattaaatgagaaacctctcaatattaaggacacatcataaattattagcatgctgtgttataatgactaaaagtagtatcaacaatttagataagtatagtgtggccttacggatgtaagtccgtaagatcatgcagcattgaagatgtgcagtttactagatcttctaatattctcgggtgtctcactgtttcttttttttttttttttgagatagggtatcactttgtcacccagtctggaatgcagtggcgtgatcagggctccctgtagccttgacctcctgggctcaaacctctcacctcagccccctgaataacggggattactgatttgtgccaccaagccaggctaatttattttctttctttctctctttctttctttctttctttctctctctctctctctttctttctttctttctttctttcctttctttccttctttctttcttttctctctttctctctctctctctctctctctctcttcctttcttcctttctttttgtagagtttgggtctcactatattgcccaggctggtcttgaactcctggcctcaaatgattctccctccttggcctcccaaagtgttgagattatagttttcagccaccgcacccagcctcactgttttcttcagttgtttctgaacaactggaatctcagctgtctttttccattaaatcccgtgttcgttcctccataccatgctgcctcttgcccatttttgcatttctcctttctgctttcctgaacatcctgagtcttactgggctggcattcccttgttgggacaggggagaggctctaggccttggatccttgttctgattccttctccaaagagttttccctttttcttcccctttcaaaacaacataagtgcaaaagctttgtcaggatgttgggaattaaaaaagcttcagaaacattttgattcatttaacaacattactctgaaactttttagagtaagagtaccaagtcactgaataagacgatcttgaaattaaacgatattttacagttttaaaaacaccttcacagatcttttcttattagattctcagcacaaccttatgagttggcactgtcaaaattcagttcaacaaacaaaatccaactaacaggaaaactcacagctaacatcatacttaatggttgaagactgaaagctttcccccttaagatcagaacaagacaaggatgctcttgccactcctattcaacactctattggtggttctaggtggggcagttaagcaggaaaaagaaaagacatttatatcagaaagaaataaaactatatttaccgatgacatgatcttacatgtagaaaaatcctacagaatttaccaaaaaaaattggaactaataaatgagttcagcaaagttgcaggatacaagattattatctaaaaatcagttgcattcctatatgctagctatggataatctgaaaatgaaatagaaaaaattccatttataataacatcagaaagaataaaatacttatgaataaagttaaccaaagaagtacactaaaaagtacactaaaaaacagaaaacatgttgaaggaaattagagatctaaataaattgaaagacgtcctgtgttcatggcttggaagacttaatattgttaagatgacagtgctacccagatttatctacaggtttaatgcaatcactatcacagttcaactgcctttttcccggaaatggacaacctgatcttataattcatatggaattgcagagccatatttgccacaacagtcttgaaaaaaagagaacaaaattgtaggactcatacttcctgatttcaaaacttattacaaaactacagtaatccagatggcatgtcactggcatgaggagagtcttgtaaaccaatggaatgcaatttagagtccagaaataaacccatacatttatggtcagttgattttgaccagggcgccaagatcattaactggggaaagaataatcttttcaacaaatgttgctggggcaactggatatctacatgtaaaaaaataaatttggatccctgcctcacatcacatatgaaaattaactcagaatggatcaaagacctaaacctgttaagttcttcgaaggaaacataggtgaaaatctgtatgaccttggattaaatggtgatttttaaagatataacacaaaaacacaagcagtgaaagaaaaaggtagataaactggactttgttaaagttaaaaactttcatgcatcaaaggacactgtagaatgaagacaactcacagaatgggggaaaatatttgcaaattatatctctgataagtatatatattttatatatatgttgtttatatccagaatatgcaaagaaccctttcaactcaacaaagataagacaatggaatttaaaaatgggcaaagcatttgaatagaatagacatttctccaaagaagatgtacaaatgacctataagcacatgacaagatcttcaacatcatagtccatagggaattacaaatcaaaaccacaatgagagataacactttacaccctctaggatggtcatactttttttttttttttttttaaagacagtaacaagttttgataaggaagtagagaaattggagccctcattgctgatgggaatgtaaaatgatgcagctactgcacaaaagttttgcagttccttaaaaaactaaacatagaataactcagcaattctactcctgggtatagacccaagataattgaaaacatatgttcatacattaacttgtacatacattaacatgtggcattattcatagttgccaaaaagtggaagcaacccaaatgtccatcagctgatgaaatgataaatacaatgtggtatatccatacaatgaaatcttatccagctgtaaaaaggaatgaagaagccaggtgcagtagctcacaactgtaatcccattgctttaggaggccacgatgggaggattgcttaaggccaggagttcaagattggcctgggcaacatagacccagtctctacaaaataaataaataaaaagaatgaaatactattacgtgccacaacatgaaccttggaaacattatgctaggtgaaaatccagtcaccaagatgacgaattgtatgattctgcttacgtgaaatgtccacaataagcaaattcatagagacagaaagtagattagtggttgagaaggagtgagagaagggatgaattgagattaacggctagtagggacagagtttctttttggggtgatgggactgttctggaattagatagtgattatggttgtacaacatagtaaatatactaaaaaccactcaaaggctgggtgcagtggctcatgcctataaccccaacactttgggagactgaggcgggaagattacttgaggccaagaggtcaagaccagcctgggcaacacagcaagaccttgtttctacaaaaaaaaaaaaaaattgttttaattacctgggtatggtggtgtgtgcctgtagtcccagctactttggaggctgaggtgggaagatcacttgagcctgtgaatttgaggttacagtgagctgtgattgtgccactgtgatccagcctgagtgatagagcatgaccctgtctctcaaaacaaaaccctccaaaaaacaaaaaccacccaagtatacattttaaatgattaattttatgtgaaatatatcagctgggcgtggtggttcacacctgtaatcccagcattttgggaggcagaggtgggcggatcacgaggtcaggagatggagaccatcctggctaacatggtgaaaccccgtctctactaaaaatacaaaaaattagccaggcatggtggcacatgcctgtagtcccaactactcaggaggctgaggcaggagaattgcttgaacccgggaggcagaggttaaagcaagccgagatcatgccactgcactccagcctgggcgacagaacgagactctgtctttaaaaaaaaaaaaaaaaaaatctcaaaaacggcaatgagaactcaattaatatttatcatactgtatattccctgagtggtgcaggagaatcagagcttagaatcttgtgaggaaggcatggtacttaaataagtctagtgtaaggcagcttgtaataagtagtactaagactgctgaagaagcacaaataaaggagatattctatcttactaggaaccagggagtttcacaaacttggctttgcaaggtgggaaagattttcacaggtggaaggggtttgaaatagggaattcagtcaaaaggaatagtgtgagtgaaggaatggagtttggaatgtggggtacatggggttggggtggggtattgaggtagatgacgcagaaaaataagttaaagatagatcttgcataggtggctgtgagtagcatgctaaggagtttgggctttattacttatgaatcatatttttggtttcaggtcatgtctggtggcagagggaaggctgaattggaggagaacaaaagctagaaccagggacaacaattattaccattgtagttttttaggagaggtgatatggctgaactaggttatggttgtgaggctggaagggaggcacatccaagtgacagtgcagtagacttagtagactcttgattgtttatgtgtgcattccagggataggcagtgaagggaagaatgaccctgaaatcttgaatttaatgacttgaaaggataatgatggtattaacagatgaggaacatagcaagacaaacaaatgaaaaagtgaatactgaggagaaggaggtaccactgaatttggcatttagtcattggtgattttgaagacagcagttacagtaaagtggctgctggaaaggatttcaaagaatggttgaagaagatagccataggatgagaacatggaaggcaaggaagggagacttgagagatttggtaataaagagaagagagaaaagggtgctagtttgaaatgagttaaaagaactacagagtagaattaaaataaagtagaattatgggatttttgctttttaagtgacccatgagaggcttactggcagtgtgccaagattcaagagagcaaagattggcagggtgggattaagtgatgggatagccgggtgcagtggctcatgcctgtaatcccagcactttgggaggctgaggtgggtggatcacttgaggtcaggaattcgagatcagcctggccaacatggtgaaacctgtctctacaaaaaatacaaaaattagccgggtgtggtggtggttgcctgtaatcccagctatttgggaggctgaggcaggagaattgtttgaacctgggaggtggaggttgcagtgagccaagatcgagccactgcactaactccagcatgggtgacagagtgagactccatctcaaaaaagagaaaacaaaaaacaaaaaaaaacgacggtagggagccttctgcctctttaaacatttgagatgcatgtcctgagatgcttctgtgaagttaagaatattaattttttgatacgaatctgacaaaactagacatcaaaatatgccatatatggtaattaaaacaatgtggtattagtatagaaagcagacaaatagttaatgaagtagaacaaccaacccagaaatagaaccagatacacctgaaaacttcatatatgaggtttaaaatcagtgtggaaagctggaaatcacccatagtttcgttatccagtcagttgtttttcacattttggtgtgtttccatttagttggtttgccatacttttttaaaaataatgctttaaggctgagcgtggtggctcacacttgtagtctgaagcaggcagatcacttgaggtcaggagttcgagaccagcctggccaatctgatgaaaccccatctctacaaaaaatacaaaaattagcctggtgtggtggtgcttgcctgtagcctcagctacttgggagactgaggtgggaagatggcttgagccagggaagcaaaggttgcagtgtgctgagatggcgccactgcactccagcctgggtgataaagccagaccttgcctcacaaaaaaaaaaaaaatgctgtaaagtaaaagttctgtatacaattctgtgatatgaaccctaccttagtgtgttatgaggattttgatccttatatgatatgatatatataatcaagtgcgggtacgttgtagtttacagaaccattactttgaaacaagacctttaggttactcctaattcatcactgttaaaataatgctgtagggaaaaaattacacataaaagttttctatatttaaagtgatttttgtgagacaaagtttatttattgtaaaaacagttccagcagttcagaattgtaaagagttttacagaattgtaaagagttcagaattgtaaagacattttcttgtctttctccttggtggtaaccactgttaacagtttagtgtgtatcttttttttaagtttagtttttatttttttgtagagacagggtcttgctttgttgcccaggctggggtgcagtggtgtgatcatagctcactgcagcctcatactcctgggctcaagcagtcctcccacctcagcctcccaagtagttgggactaccggcatgtaccaccacgcctggctaatttctgtatcttttgtagagacagggtttcaccatgttgcccaggctggtctggaactcctgggctcaggcgatccccctgcctcggcctcccaaagtgttgggattacaggcatgagccactgcacctggactagtttctttttaatttctgagtagtagtcaattgtatggctctcctataatttcttcattcattcatcttttggtagacattcatgttgtttccatttttaggctattatgagtacagctgttgtgatcatttgtgtgcgagtctttgtgtggatatattttcatttcttttgactaaaaacctaggggtgcacttgttgggtcacattaactttgtagaaactgcattgcatctttgccgatattgaaagttgtcagccttttatatttttctgtgcatgcttttccccccaaaagaccaaaatgggaattgtttttcttttcattataaacttgtaaaggaattttaaagttctaagggatgccaggcaggaggttcatctatgtgaacagttattagtttgagatagataatgtcaaggatatccctaaaggcttttcaagagataactataggacatataagtttaacttatttctaccccatcacttctagtcacatgtgacttcagaattttaacagaaattattattataggaatatgtagcacagagggattccataggcctgaagattagtactgatggcctttcttgcattattctaggctagtgctatccgatgaaactttctgcagtgataaccactagccacaggtggcttttgaaacgtagggctagttcaactgaagaattgaatttaactttaaattaatttgaatagtgaaatatgtctagtgattaccgaacagtgtagttctgaaatgttatttttcaggaaagatcctctagcaagaagtagttgagtgagacctgttagctgagctggccctggggcaggtttgtgttttcagtccttccctttcctgtgggagaaatgaaaccaaagcctagagcaccacagaagaagaaccagtggattcataagggtgacagttcaggtaggggaagctgtttggtaatgagctcttttggtcagatgccacactatttttctttctgtttattttgccctattaaattatttagtaaatagtaaagcgtactttaatccagtttttaaagtggacgtttggatgaaagtatgtgatttaaattccaaaactgtgcagtgttgtccagaagagtcctgattaaatcaccccagtttctttgatgaagataagcaaataattttattttttgctgtaatcccagctactcggaaggctgaggcaggagaatcgcttgtaccagtccggaggctgctgccctctcacagggcttcctcctcttgcacagacgcaccagtgccttcagccccactggtctccctcttctcctttcctggcccctgctggcccagtagatgggccactggaggccactagatgggggctggggaatgtgatgttggcgatctgcggtatcttcagggtgacagccatacccaacgcgtgggacctggcttccacatctatagacctgacctaaggaaatatgtgggcgtgtgcataaggatgccatctcagaactgcatattaataaaaagctgaatcaaacagtgtccaacaagggtggctgttccagctggtcatctacaatctcagctcactgcaacctccgcctcctgggttcaagcaattctgccttagcctcccgagtagctgggactacaggcacacaccgccacacccggctaattttttgtattttagtagagatggggtttcaccatgttgcccatgctggtcttgaactcctgagctcaggcagtcctcccaccttggcctcccaaagtgctgagattataggcgtgagccaccgcacctagcctgtactttcatttcttaataactgcatgactgtagtggttggctttcattattgtttcctaggggcaaggtcaatgttagaaaaattgtggaattttcccttggcattgctgtggtgagtagacagctactatttatagagacttatacttcgttgaaaaaatgagataccatgcctggcttaccataaaaacacagatgtttctggattccagtagggaggccttttgttcacagcatctgttttggttggccagccagatgacttctgtggattttttcactccttttgaaggacacttgacaaataaacaagtttataaatgaaagagttaacagcattttgtaaatttattttattactttagctatatcgttctgtatattttgaactatcagatcattttagctcaattttatcacttcctaaataaccttgagacgatcagtcctttgttacatgttctttggattgtttattctgcagttgagacagatttttattgatctataaatttttgtgttcaacaaacatttaatgagtattcactgtgtactaggccctgtactaacactgggaactacatatgtgagcaagatatagtctcagtctttgagaagtttagtgtcttatatgcagtgcaaacatgtagacagaataaaattatagttgagtccttccatttgaagtttatttcatcagtttagtggggaggggtaggtgtctaggaatgccttccagaaaaagtagtgtctaagtggagaattgtagaatgagtgggagttgtccagggatggaacaggggttagtggcggagattatataaaagaaagaagcttgcaggtgaaaatgaccctgggaaagtgggaaactgaaaaagttcagtacatttctgtcatatggctgatcaagctgtgactgggcaaaatgctgtcagcatttgttgaacacataaatgctgtctcattcacaaaggagacttgtgacctagactttattcatcttgtgctaaattagtgatttccaaacatttgatcatgaatctcataagtaaaaaatgttttgattatgtatcctcatatattgattatatgccaatatttgtttatagatgatatgtagtactaaaagttatatacgcagtagaacatgtatagaaaacaaaaaaaattaaaaggatgagctaaagatggcatgtacaatattctcacagtgttaattttactgaaaatacggaaagtaggctgggtgcagtggctcacgcctgtaatcccagcactttgggaggctgagggaggcagatcacttgaggtcaggagtttgagacaagcctgaccaatatagcgaaatcccatctctactaaaaaatacaaaaattagctgggcatggtggcacacgcccgtaatcccagctactcgggagggtaaggcaggagaattgcttgaacccgggaggcggaggttacaatgagccgagatcatgccactgtactccatcctgggcgacagagcaagactccatctaaaaaaaaaaaaaaaaaaaaaaaaaacccagaaagtaaagtggtacatcattatttaaaatcttcgtttaatattatgtgatacagctgctcagagggctgtttctaaattcagtttattttgatactttaatggcagtcaaagcctggatcaaaatggaagaatttggctgcactttctaaatcatattctttctttctccaaacttattcactatttatggaaatgctttattgaaatgtggctggtaaatatccatctattagtttttcttgcagattaataaaaatatattatacttttattgtgttaataaatgggttccaaaaatcactgttaagtcttcatttggaagatattttaaaaagttttagaatattctgtttctgactttataaagcatgaagatacgagtttttggtgtctttattttttagattttgtatatattgtttcaacagcagaataacttagcaatggaaatgtttccaattatccaattttgaaatgctctattaggaaagatttttttttctctcgctctctttttttttttttttttttttttttaaagatgaagcctctctcttgtccccaaggctggagtacaatggtgccatcttggctcactgtaacctccgcctactgggttcaagcgattctcctgcctcagcctcccgagtagctgggattacaggtgcccgccaccacgcccggctaatttttgtattttaagtagagatggggtttcaccatgttggccaggctagtctcaaactcctgaccttaggtgatccgcctgcctcattctcccagagtgctgggattacaggcgtgagccactgcacccggccgatttttttctctttttcttttttctggaaaagctgaaaataattctgacatgttgctaaacatttttattttgtaggggcagagtgagtttttttgtttttttaatatcttcttggtagcatactacttataacctcctcagaaatatttagcaagtttggaactctagtctttttattttaaaaaaattgtgtaactcatctacatttaacaaatcttttaaatacatttcttgtggtaactagtgaatctgtgtggatttaaaaacaaaaaaaagattatgaggccaaggcaggtggatcacttgaggccaggagtttgagaccagcctggccaacatggtgaaaccccatctctactaaaaatacaaaaattagtcagaagtggtggtacacaactgtagtcccagctactctgagctgagaatgcgccactgcattcaattctgggcgacagagcaagactatctctcaaaaaaaaaaaaaaaaaaaaattcagtggctactctctatctcccagagtataggaagattctatattcatacagttaacctcagtgacatctgaggtaccttgttctgacttaattgcagcaatagtttacctgtgaatgaagccgttaaaggcttttgtatcagatgctatcactgtaactttgttctggaatttttttttttttgagatagggtctcgctctgttgcccagactggagtacagtgacacgatctcagctcactgcaagctccgcctcccgggctcacgcctttctcctgcctcagcctcccaagtagctgggactacaggtgcccgccacaacgcctggctaattttttgttattttttagtagagacggggcttcaccgtgttagccagcatggtctcgatctcctgacctcatgatccacccacctcggcctcccaaagtgctgggattacaggtgtgagccaccgcagctggccagaattcttttttaaaattccagtcaaagcagtcatttcatcagtggttacagttttcccataaagcaccttgtttcatttacagttaagaatacctcccttttaatacattgttccttggtatcttacaaagttgtatttcctgtatatttcataattacccagcaaataccctaagatgaaagaatcatctgtatttttatccaattgtatagcaaaccccacacactgtatttgtcctgatatcttcaagtctttagggttttctaagagcttttgactatacttaccaataaaagaatacatttagtttgtcaccatttttatttctgtgtataatttcagctatggtccttggctttttttagggaaaccttagcagtttcgacactaactttcgtacaattttgtgaagtgtcacattaaatagcctgtgactttagacataggtggaaaaattatagacgtttaactcttgcagtgaacacttaaaagcctggtggattatgaggactttgttcgtgccatcagattatatcttaaggtagagtagacatgtagagtgaggttcatctttaataaaaaatgggctgggtgcagtggctcacacctgtaatctcagcactttgggagaccgaggtgggtggatcacaaggtcaggagatcgagaccagcctggctaacacggtgaaaccctgtctctgatgaaaatacaaaaaaattagccaggcgtggtggtgggtacctgtagtcccagctacttgggaggctgaggcaggagaatggcgtgaacccgggaggcggagcttgcagtaagccgatatcgcaccagggcagtccagcctgggtgacagagtgagactctgtctcaaacaaattaaaataaataaataaatagataaataaatggtgtggctggacgcagtggctcacgcctgtaatcctagcactttgggaggccgaggcgggcggattgcctgagctcaggagttcgagaccagcctgggcaacgtgatgaaacccccgactctaccaaaaattcaaaaattagctggagcatgcctgtaacccagctacttgggatgctgaggcatgagaatcgcttgaaccagggaggcagagattgcagtgagctgagatccaccattgcactccagcctgggcaacagagagagactgtgtcaaaaaacaaaacaacacataaataagaaattgtgtaaagtcaatataaataccagtactaatattttatttttataccccaaaggattatcgtataatacaaacacccttcaagtacacatatcccactttggagactaatgccctaaacaacagggataatgatattgaaactggccttttagttaaaataaaagcaaagccaaaaataattcactttcctctataaatttatatttgggagacacatttaagaataatcgtcctggccaggtgcagtggttcatgcctgtaatcccagcactttgggaggccaaggtgggcggatcgtgaggtcaggagatcaagaccatcctggctaacacggtgaaaccctgactctactaaaaatacaaaaaattagctgggtatggtggcgggcacctgtagtcccagctactcaggaggctgaggcaggagaatgacatgaacccgggaggcggagcttgcagtgagccgagatcacgccactgcactccagcctgggtgacagagtgagactccatctcaaaaaaaaaaaaaaaaaaaaatcagctttggcttgaggtttgaagaatgaacccttcagtcatagactatgactacctgtcatagctcactaggaaaccctagggaatcatggaagggttattggttaaatatattatataaaggaacattttgctagttgctattgaccaaaaaggctgttttttttttttttaaatatagtctgtaattatttttgttgaaagatatttggaagatggtttttctcaatctataggagatacagttcgtagccacctgggatctcttataaaaagatactttttcatagtatactctttataatatgcataacatttcataatatacttttgataatatacataaaatttgatacataagtttaccaaatttattgaatttacttcagtgcatttttattagtcaagattctttggaagatatggaaagctaattcaaaaaagcttgagcaaaaaaaatttgttggctcgtaactaatgttcaggactggtctcaagaacttggttgccagatctgtgtttccaggttatctattagcttgtctgtgtctctgtgatagttttacccttttagagtggaaaatcttcctccttgtggtgctctggcttgcagaagaatgcctttggtctagcgccagcatatataaaatcctgtgggtgggatagagtagatgtggttgcatgtgtgctgactggcagtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagtgagtatctgactttgttttcttttaacctgctaagtggcattcgggaaacttccagagagtcatttttaggaaacgttggaaaatatttttaaaaaattcttgctgagttggaaaatggagaagatgagaaaaagttatgtatttgaatcattactgtgtcaaactttgataaatactgtataatgttttaaaaatgttttatgtataaaactctagttttcatcagttttcttagtagagctaaacatactggttgtatgaatcatatatggcagagttgttaggtgtttggttctggcaaactcagattgtttgagttttcctggctctaccaattacaaactgtgtgaccatttctgtacctctatgtcctgatctgtaaaatggagatgatctcttcctcaaggtagctatgaagattgagttacataaataaagcacttagaacagttcccaacatgttaacaatcccttagtaaatattagctgttatgattattattaccatgataatccaagagacatgaacattggaagatgggctgggtatggaggcttacgcctgtaatcctagtactttgggatgccaaggcaggctgattgcctaagctcaggaatttgggaccaacctggccaacatggtgaaaccccatctctactaaaaataaaaattagccaggcatggtggtgtgcgcctgtagtcccagtttctcaggagactgaggcatgagaatcacttgaacccaggaggcagagactgtagtgagccgagatcgcgccactgcactccatcctgggtgacacagcgagactctgtctcaaaaaaaagtaaaggaaaaagaaaattggaagctgcaaagcaaatgtagaatccttaaaggcattttgcactgtaatttattttaactgattcatatcaccgcactgccaggacttctaaagaccctgctgcaagttcagtgccatccatatgcttctgagattggtacagataaggagatgaaggggctgtagggaaataagaggcaaggtggtagggttttaactgagcatttttcttaaaatgttatctgtgaaatacctgagtttcacagagttagaaatgctaatcatctttggtttccagcttcagagtaagaggctgtactatatggtgatattaacattgtttccagtgctaaacattctgtgatgctaaattgagcacaggattttcaacagataaactgaagtatagataatcaacgtgagaatttgtggaattcttttacatatgttaaatgttcactgtactcatggtggggttactcaaaatgtagttgatataaggaacatgtgttctagtggcaaaaaaaatacgtatagaaacattagccattgatgtgaaaaattacagcattctgaaaagataatgtttaaaaagatagtgagctaggcatgttagggcatgcctgtagtcccaactactttagagactgaagcaggagaatctcttgagcccaggagtttgaggccagcctggtcaacatagcaagaccacatgtattaaaaaaaaaaaaaaaaaaaaaaaaagatactgctgctgcataacaggatttgaagcttctatcttacacatagtactttttagttacctggtataggagattatcatgagaggactgtttttttttttatttacaggtaatttctgaacagggaattagcacaaaattttttaaaacagtaaatattgatatctacatgaaagctgatgtattttaggaattttttaaatcttttttttttttattttgtaggttgtttttgttttagcctgttgagagagtctgcaaataaatttaatgagtagtctaaaaactaacttttttttgattgctatatcctagctcttttatctttggctctcttctccttattaggatgtgaagtaattctcaggagaggaaatgcatctagtttttacttgatatcaaggactctaaatcactggcttcagttttatgtaaactggaaatgtaaggaagttggtattttggatggtattttggctggattctacttgatgagtgtttgacccaaggtgctccttatatctggaaaacatttgggattgctgatagtttgggaaactaaatttgtggttctatttcttcaagacacagatagtgtcgtttccacctgatactcattaaatatcagtttgacaagaaatacattttgaaattatgttcttcatttccttcaatgtggagtactaactgtgtttctgtcctttaggcatgtgattgtgaggacctctcccaatcacaggtacacatttacactgaagacacatccatcggtggttccagggagcattgcattcagtttacctcaggtaactcagatgttaatttgttctcttctgtttttgaaagtcatagaatatgaataatctgttcattttaagcaagcatcaccctgtgactgtattgattcatattgaagaaaaatatctaagtattatataaggaatttaaagatacagtcttcttttttttttttttcttttttttttttaagacagggtctcgttctgagacccaggctggagtgcagtggcacgatcatggctcctggtctcaagcaattctcatacctcagtctcccgagtagctgagactacagtcttgtaccactgtgcctgactaattttaaaattttttgtagggatggtgtcttaactgtgttgcccaagctggtctttaactcttgggctcaagtaatcctcccaccttggcctctcaaagtgctgggattatagggtgtgaatcatcatgcccaacctaaagacagattcttaattgccagtttttgctatggctgccttcttttggcttgattttttttccctaatttttaaagattttgcagtaaaatcagtcagctatcacataaagcgtcaagttattttaatgttaactgccagggtaatagaaaagtagaaaacattttatttgtgaagttgatatctaagaatggtgattttataatgtgatggcgttatactaaagaatttggaaagagtctcaaattacaacataatttgctaggctcccataacaactggatgggttgtgattacagttacaactgttgatggattctgtagaatccagagaattagattgcttagtgctgtcccaggcacatcatacataatataaagcaccaagaatactagtctgtatcctcttctcccttatcattttactcaggctgctgactgtccccagtcctaagtaatgtaaatggaattcctacctcctcctagtatgctaatgagcattggttgacttccctgaaggtttagagaaagagatcaaacactcatttaagaactattaggctgggtgcaatgactcatgctggtaatcccagcactttgggaggccaaagctggtggatcacttgagtccaggagttcaagaccagtgggcaacgtggcgaaaccccacctctactaaaaatataaaaattagctgagtgtggtggtgcatgcctgtagtcctaacttcttgaggggctgaggcaggaggatcacttgagcccgggaagttgaggctgcagtgaggcgagatagtgccactgtactctagcctaggtgacaaagtgagaccctgtttaaaaaagaaaaaaacaaaaacaaaaactattagatgggccaggtacctcacgcttgtaatcctagtgctttgggaggtggaggaggatcgcttgagaccaagaattccagatcagcatagcgagacccttgtcccccgcactagtctctacaaaaaaaaaattttttttaattagctgggcatggtggcacatgcctgtagtccaggctacctgggaggctgaggttgggaggatcacttgagcctaggaagtcgaggctgtagtgagctatgattgtgccaccatgctccagcctttgctccagagtgagattctgtctcttaaaaaaaagggaaaaaaaaggaactattgaagatctcttgaagccctcaaaaattacaggaaattttcacttactattccacctgtctgtttgatgcctcttcattatccagaccactttcacgtttgtttctatagattaaaagtttgggatattccagggttctccagcttttacagagttccatttgggattctgattgttagcaatagcttgaggtgtgacagtttctccttgtctctgttttgtaaaaaaaaaaaaaaaaatttccccgacattcactgtaggccagcctctattctaggtactttggcatgtgttagctcatttaattctccaaacaaccttatacaatagctactgttgttatccctaaggactgttgtattagtccattttcatactgctatgaagaaattctggagactggataatttataaggaaaaatgagatttcatggactcacagttccacatggctgcagaggcctcacaatcatggtggaaggcgaaggaggagcaaagtcatgtcttacatggcggcagacaagagagcgtgtgcaggggaactgccctttataaaaccatcagatcttctgagacttactcactatcatgaaaacagcatgggaaaacccacacccatgattcagttacctcccactgggtctctcccataacacatagggattatggaaactacaatttaagatgagatttgggtgggggcaaagccaaaccatatcagctgtctttgggattgaagtacagaacctaaatgtggcttccttgtgacttaaagtctaagcttaacgagcatggtgctaaatttcaggttggccagaagtgggatggggttttacagaagaggtcttctgggggaggtgaagggcagagtggagggaaacaggatgtggtaagaaagccacaagggagagcacttgttgcacatattcacagttcagtgtcttctaaattacccgccacaaagtctgcagtgtttggatgggcaggtgaactactgattttcaaccaaaaattgtttttctcattgttctttggagtgttatcagtaattactaattttgaatctataccaagcaaaccccagattcctgcctaaacacaatctggcctgccttcatacttcttgccattgtaaacagtagggatttgggaaagcctgaaatctagctgtaaatgtctaaaaatcttctggctagtatacaaagagtagccatgaccatctaatgatttcagtccctgactgggtttcaaaatagattttctgaccagttttaatttagtcttcatgaattgaatgtcttcctttttgagatactgtaacaaacagtaaaactaactgcagcagtacatttagaacactgaagtgtgatctgatacagtgaagaccttctgtagcatcatattgtgcaaaggaacatcctcctcagtggtgccagctttactgcaaaaggcaagctttgcacgttttgaaacagatgttcagatgtaaactgtagcacatgctttactttcctagggtaagtaacaaagaaccattactgggtagcttaaaacaacagagatttattctgtcaccgttgtggaggccggaagtctgaaatcaaggtgtcagtagagctattccctctctgaaggctctagggaagaacctgttctgtgcttagcttctggtgttgccggcaatcctttggtgttccttggctgtagctgcatcatttcaatttctgcctctgctatcacatgatggcattctgtctgtgtgtctatgtctctttcttagaaggacaccagtcatatcggcttagggttcaccctaattcattatgacctcatgttaacttgatacatttgcagagattgtatttctaaataaagtcacatccacaggtgttgggggctaagacttcaacatactttggagggggagagcacagttcaaccataatagcataccatgttttgatctttgagtgtattcctaaaattcattaaaattcctctttttctcttgtctaattttgatggctttggttttaagtatctttttttctcctttacagagaaaatgggctgggctttctattgggcaagaaatagaaggtaggtatattttttagccacctgataaagattttctatgtgattttctcacagttattgagatctgtacaattttctattactagtggtcagatcttaaacattcattgtatcagaagactggttacatctatgagaatgggaaggaaatagttatggtacctctgttcctatatcttttatgaagtgtgtgataaggtcgtcatagttcaaggcaaggaaagcaatttatgacttccagttgggggcgtggcggggtggaaagactaagctgctaatagataataagccaaagaactaataagcaaaaagtggcattgtctcaggcaatgtggcaaagttaggaaatggagtatgagtcgtctttagtcagatgattttatgtcaacttcatggatacagtaggggaaggaaagaaaatgcaagtgtaattaaaccagcttttcttctgcttgtctttaaaacttaaaaaaaaattgtatttatagaaaggttgcaaaaataatacgaagaatttctgtatactacctttacccagctttaccaattgtcatattttctttatcattctggctccctgtcttcctctctgggtctctgtctctctctgtacacacacacacacacacacacacacacacacacacacacacacatcttttatcctactcctcatttaggaacctgacaacttgtaattttttctaagttagatggaatttaaacattggggttattttattttattttatttttgagatggagtctcgctctgttgccaggctggagtgcagtggcgcaatctcggctcactgcaacctctgcctccagggttcaagcgattctcctgcctcagccttgcaagtaactgggactacaagcacttgccaccacacccggctaatttttgtatttttagaagagatggggtttcaccatgttggccaggctggtctcgatctgttgacctcgtgatccacctgccttgacctcccagagtggtgggattacagatgtgagccaccacgcccagccaacattggtgttatttttagttagctttttctttgtggaagtatgaacacttgttaaatttaatgagaaagtggggtagtatgtagcttaggtttctaattttcataaattaatttttctaaatatgaggctaagagtacttaaaactttgaatctagatattttctattgtgacaagatacagaaattcaagattataaattttgatgagttgagaaatgtgttttgcggtttaagttataaaagcattcttctgctaacagaaatgcttatctggattgtaaagtcagatctttaaagaagtggctcaaacagacttaataagcaaaattgtaaaacccagtgataggtgggactaaagtggagtaagcttgagggaaggtagggttttggggcccaagtgatgtggatgatgtagccataaagatagaaaactggtttggtttaagtagtgatgtagaccaagataggataggaggtgtggtttgaaggagtgctcaagtattctggaatgggagttccgtaaggtgaaacattttagtcaaatcagtgattttagtctgagggaatcttctggaggaatcatttagtcggtcttctttccatctggcaatgccatattttaagtgttacaggctgatgttttgaccactatatatacacctattattgtaaagtccaagtttattcaaagaactggatacacttattttttgcttataaaatctttcttattagtcttttatattaaattactattagccgtaaaataagaaaacattctcaatcttctttgatccaggatgaaatcttcaggactcttgtccctttgggactgaccatggtgctgactgtggtgctgcctgggatactgtccatggtgctgcccatagcacttgaaattgtaacagtttggtcttttctatttaggaacattggccttaaattaaaatgcatttgaaaactacagtcagtgcattactacagtcagtagtaattatatttttatttatttatttttgagatggaatctcgctctgtcgctgaggctggggtgcagtggcatgatctcagctccctgcaacctcctcctccccagttcaagcaattctgctgcctcagcctactgagtagctgggattagaggcatgtgccaccacacctggctaatttttgtatttttagtagagaaggggttttgccatgttggccaggctggtatcgaactcctgacctcaaatgatccacctacctcagccttccaaaatgctgggattacaggcatgagccaccacgcctggccaatattttaaatatacttattcaaatttctcagtatgaagatgacatgaatatatgtatatacacacatatatatgcattatgacattatgatattgttttggtgtctttaatgcacaaaatggtattatactgtacaaacctttctgcagtagacttttgtcactcaatattatgttttcaagggccatccatctttttttgagatggagttttgctcttgttgcccaggctggagtacagtggtgtgatcttggctcactacaacctctcctcccaggttcaagcaattctcctgcctcagccatctgagtagctgggattacaagcactcacccccacgctggctaatattttctatttttattagagatggggtttcaccatgttgaccaggctggtcttgaactcctgacctctggtgatccacccacctcagcctcccaaagtactgggattacaggtgtgagccaccacgcctggccaggccgtccatctttaataaatatacataaagttggtttttgtttttttgttttttttttgtttttttgacagggtctcacttggctggagtgcagtggtgcagtcgtggctcactgcagcctcagtacctggctaattttttaattttgtgtagagatagggtttcactgtgttgcccagtctggtctctaaatcttggacttaagtgatcttccctccttagcctcccaaagtgctgggattgcaggtgtgagccactgtgcctggccaagttttaatttcaataaaaattgctgtaaagtattctacattatgaatatactacattttattcattgttctcctactgataaacatttttcaatgtttaagtactataaataatgctgcaatgaacctccctgtagatgtgttgttagacaaatgttctagcatctttctgggacagacatctagaaatggaattgctgaatcatcatattcatttttacattaatatttcaacctataaatgttttcaaactacatgagggaaacaactaagctcttttgcctatcaaagttactcagcatataacctgtactttctaggattttttttttttttttttttttgagacagagtttcactcttgttgcccaggctggagtgcaatggtgcgatcttggctcactgcagcctcgcctcccaggttcaagcgattctcctgcctcagcctcctgagtagctgggattacaggcatgcaccactgcgcccggctaattttgtagtttttagtagagacggggtttctccacgtttgtcaggctggtctcgaactcccgacctcaggtgatccgcccaactcagcctcccaaagtgctgggattacaggcatgagccaccgtgcctggccattctaggaaatgttaagaaggagcaagccatccagaattggagacaggagagtattctgaaacttttagccaaaatttgaacttattatttgatcttcagtgagttttatgttccttcctcaggctttgttattttgcttttgaagtagttaaaatatgtatatgtccccctttaaatacagaaatctgattatacaaacaatttcatttaaagagtttacagaaaatcggccgttcgtggtggctcacgcctgtaatcccagcactttgggaggccaaggcaggcagatcacttgaggtcaggagttcgagaccagcctggccaacatagtgaaatcctgtctctactaaaaatacaaaaattcgctgggcatggtggtgtgcgtccgtaatcccagctacttgagaatctgaggcacgagaatcacttgaacccgggaggtggaggctgcggtgagttgagatcgtgccactgcactccagcctgggtgacagagcaagactctgtctcaaatataaaataagagtttacagaaaatccttgtacataactcaagggtctagaatttaagaaataagtttagaacagaatttagagtgtgaaacgaccataaagacttatctagttcagtcttgatttatagatgtgacaaatcaaggcacagacaacttaaattatttacttggattcttctgattgctagcagaatctgttgaaacacacatactcaaagtccctttgaagaaaacagctttgtttgtaaaccactagaatctttgcaacagacatttaatactgcacagtgacttcttttgtttacctcttgctatttgacctcagtaactcacagaaatgccatgcctgttgttcaaagcaagtgtgaaaaaacagtctttgtttataacctgcttttgtggtgagaactgtagaagctcacttacccaatgtgacttggactggtaattaagtgaaaagttggttaaaggctttttcttggaggtgtggtccatggattggagttctgtattatcttttgtgcatacactttacccataatttccaggtggatttctttgaaatggctggagaacttagactttgtagagcatctgagagtgccaaaacctcttggatttttgtagagttcactcccaaccttttctaattttaatgcttatacctagttagcagtattttttttttctagaagaaacacttcatttaaaaaattttcccaaagctttcaacttataatatctattctagaatgtcaaagtcattgtaataacagttcaacaaccaggccttcagaagtttttatactatttaattatatttcataattaactgtaacaagtgtaactagcacagacagataccagaatgaacttggttgacccatgatgtgtagcaactcctgtctacaagctctgagcgttaggcaaaccataggctgatgggtatatgttggagggataaaagttggtcagctttctgatgactcagctcagtggaggttgcttacgagagctgctactgtatccttaaggggccattggtaaattttaggacaagtatcttcagggaacctaaagggaaaataaatgtgtgtgtgtgtgtgtgtgtgtgtgtgtgtgtgtgtgtgtgctcgtgtgtgaagccttattgaagagtagcaatagactctttcttactaggcgtaatcaagttgccctcctggggaaactcaaatgcaaaaatcctcttgaacttttctgggtagcctactctactctttcctaatagtaccactacagtatacagcactgtaaaattttttgctttaaaagtttgtttataaactggcatttataagtatactttttgagctgatttaagaatcaagtttttttttctagggaaatgcttctttgtaattatctgtcactagcaaaatttgttttaacatatatttttctaaaaatatgatatgtaaactgtgttgtagttgtacaattaaaggtttttggtcgaacagttattacatgatgtaaaatcatgtgtaacactttaatattaattacattgtaacctaaaattcattttaaaactttttatgtggcttgaacaggaattttcttatccaaagctttgtatgtatgctttattgcctcctttgttattagcatggagaccatgggttttctgttattgttgtttcatttaaacagttcatgaatatattaagcacctgaaagaaactgttagatgctgttaataggaagaggagttaaaaacctcgtccttgcccttatctacatgtgtacatgtagaacttactgtagttccctagatgtagcaggtgctcaggaaacatttttgtagtagtaaaaaagaaatgtcaaactctaacttgctctggagcaaattccgctagtaaacattgtttttcaagcttcttttttttgccttgcgtcctactttcttaggccaaaataattcatccacatcccaccttagctgtttttttgtgtcaaacaaaaatcttatttggaaatagcatgttatgccaactgtgttggggcatcccatactgtattgcattaaatgaggagaaagatgcagaggccatgtggggaggattgtgatcctgataagagtgggatgagggataacaacagagagactgccgttcaatatttctttctttctttttttttgagacggagtctggctctgttgccctaggctggagtgcagtggcgtgatcttggctcactgcaagctccgcctgccaggttcacgccattctcctgcctcagcctcccaagaagctgggactacaggcgcccgccaccacgcccggctaattttttgtatttttagtagagacggggtttcactgtgttagccaggatggtctcaatctcctgacctcgtgatccgcccgcctcggcctcccagcgtgctgggattacaggagtgagccaccgcgcccggcctgccattcagtatttctaattaattcagatggggaagaaaatctctagtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctagtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccacctcggcctcccaaagtgctgggattacaggtgtgagccatcacgcctggccaaatgaggaatttaagatctaaagaaggtaaatggtatgcccatggctacacagctaagggacatagttgagataagaattaattaaacacatatttgatagtacctagtgcctagtaccagtcactgttttagacactgcagatcggcagtgaacaaaatagatatgatccctgctgtcatagaacttactttctagttgaagaaaacagaaaataagacaggaataccatgtacagttaggtctctgatgaaagtagatcaggacaattcaccagagagctattgcggtgctgttgtgtattggatgaccaaaattgtgctcagattgcctagctaaacttgatggtttttacctttgcttttagttttagtatcctaatagaaaatgtttaggagaatgtttaatagaaaatgctttggtatttataataatttaaaactcagtagcatgtagaagtcagtaaatccatgaaagagaatctttcgtaattcagagaagaagtaaatatcttactccagatcactgtccttaactgtttcttctcatttgtggtatctcgtagtagcagaatggacagacagcccaacctgtaatatttaccattataccccagcacatagaagaagaccaaacttttagaagggactcagcaaagatttggtgaatgagtaattgagcattcagaagctgtctctgcacttgtagggcaagcattttgtactagtgatagaaaagcaggaattgtagagtcacagacccagggttgacttctggcgctctcatttactgtgactttgagccttgttgcatagcctgtttctgcatctcagcttcctcactagtaaaatggagtcgtagtttctgcttccaagagtgtttgtgaatattatataactggctgtagtgtttgaataaaatactaagaaactttattctttgttagaaatagtaaatgtggtactcttgaattactttaggtggcactctgacatttaaattagatattttttatccatgtggaagaaattttaaacatgagttttgcagtcattttgtaaacactgatcgtaagtgctaattcccttttcttcattggctgtgagtagtttgtttgaggagcagattggagaggagtatataagataaactggttttctgcatttgaaaaacattggtgatgatctgaggatcaaactattatattatgaagtgatttttctccccttacctcttttctacatagcttgtctttagcttcaatgaaaagctttttggcttactggtgaaggacattgaagccatggatcctagcatcctgaagggagagcctgcgacagggaaaaggcagaaggtagcttttatttctgatcatctttactagatcatctttataatgtaatttgtgcagattgattataattttcctatctgttgcttagtgatttttttcatattgtgtacccttttaagatagtagggagaaaaaattgctttcatagccatcattgttattaaaatatagcttaaaatgtatttatttgcagacctaatattaatgtaaaatgtagacgtatatgtacatataatttgcttgaatgcagatatttattgtaaataaataataagaaacgcattattggaaagatataggcatggaaataaggcatgtaagaattgtagaagaaagttatgagaaaagtaaaagtagctcagatgatagtctggaaggtttgctttgcccagagagacctcatttccccctcacttttggccttgctttgagaagtccagaagtttgctattagactactaattattgtctttctctacagattgaagtaggactggttgttggaaacagtcaagttgcatttgaaaaagcagaaaattcgtcacttaatcttattggtaagatttacagtttttagaagatttgaaatgaagtgggcctatttctatatgtaactcaactacagtgatttccaaatggggaaaggaaagaggggcatctctcttgagagagtttatcacagaagcatggggtatttcctgttggtcagtttgctgatgaaaacgtttaaaaccttcatctggatcaactttgtccaatagaaatagagtgtgagccacatgtgtaatttttaatttcctagaaattgcactaaaataagaaacaaattaattttttaacttttaattttgagataattttaggttcacagatttgcagaaatagctcagagaatttctgtatgccctttaccagcttaccctgatgttaatgtcttatttgacattttcaaaagtacaatgataagaaatgaacatggtttcatttctgctaactaaactacagattttattgagatttcaccagtttttccattgtgtccttttctgttccaagatctaatttaggatcccatattgcatttagttgttctgtcttttgagttttcttcagtcactgacagttcctcagactttgtcttttatgactttgagaactggtcagttattttgtagaatgcccctcacttggttttgtgttaaatgagatagcatcatcatttcttttagtgattaagtgatgaatgtgcaggtcaagtcttcccagcagattcatggttcagtcctactcttgtactctagcacaatttttgtcatattaaaacaattgcagcttattctctgagaatagtaactcaccagaataatgtgacattaactgggcattaattcttatttttggttgatttaactatgttgatgtctaccctactagagagtagagggttttcattggttgcacatcatcatgtccagggtcacttaacagtctttgagtgcgtggcctttatttcctggtccacaaattaccattcccccttattgttttttgttaattataaaatattttatttataaaatatggataggcattcgaaaacaattcacacactgtaaaatttggttctgttttcatagttttgtaatttgctttttttgcttagcatgtttcaaacatcttaaatatacacctataacatgatttttaatgcctgtatgtcattttatgaaggtaggatgtattttcctgttattgatctagtacatttatgaagtgacttctttgtattttatttttgtgtaccttttgttaagatatcccaagggagttgcataactttcataggtatttctaagtaatccatgggaaaaaaattgtgtagttaattggcattcagtaaattttgcccacaagagggcagtagagtgtaagaaaaaaatatttttcatcgctttccaaaggaaatcttaaggcctcaaaactctaaccataaaattatcatctagtataaacttttaaaaagcgttactttatttttaattgacagataataattgtatatatttatagggtacaatttgatattttaatacatgtatacattgtagaatgatcaaatcagcctaattaacatatcacctcaaatatttagcatttcttaggataaactttttttaatgtgacattttcttccctggttttataaaaaccatattattactttattttttgtttataatagagcatactaaggtacttaatttattctttgtttgaaatagtaaatgtggttctcttgagttactttaggtggcactctgacatttaagttagataatttttgtcctcttgagaatttttaaacatgagttttgtaatcattgaagtctttaggatgatttcagacttttgtgtccaagtgaagagaaagcaaagaagacatcaaacttgttcagtatatttccttaggctgaggggttatatgcccaattacctgtataagcttaatctggataaatatatgtattttaaaataaacttgcgttaggagacttcagtgactgcgagatttcagttgcatttctgccagctagtgttgtcttcatcagatatggcatttcttctgatcaaccgagttagttaatttagttagattgaaggttaataaaactaagttttatggactgatacaaatagactacagcataagtttagctagtcattttgacagtgtgttaccatatatggagatcagacaaagtagatagcatagcaaaacttacccttctgactgtaaaatcagctaagattatattgttcgttttgtatatgtaagggtagcttttctttattcatttaggatgctcagggagttctgtctgtctttttagacttagtgataaagtccttgtttcacatttgataatattcgtttgacataggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggtaagtttaaaaaggaaaatgttataaaatcttgtgttgttaaaaaaattaatgcaatgaagaatctcttttcaatagttttgaaattatttttcagacccattatttttgtctttttctttaaaaatgaacagataaattttctgaaaaactttataataccagaacttttaaaattacattttaattttatggggaaatcatagaaataagacttgtggtggctccattttgtttatttatttattgaagaatgcttttctatggggcatatttagaaacttcccctgacagtaataatactagtagtgactccattttatttatttatttgcgtaagaatgtttttctatagggcatatttagaaagttcacctgactctaaagatcactatgggtcagatgtaccctgctgaataataactatctattaggctgtgtgcattgttctgacattagctgccgttcctttttattgtactgttgcattacccagttagtacatcttcatacctaataaatgggtacttgcatatttttaaattaaataagtttgatccaaaaagacaaatgcaggatatacattggagtttctatattgcatacaaagaagtgcactattcgtttaccactttcttcttgaaggtttatttaatttatctgtgtgaagtgactttatttgcccagtggaaatgctgtcatgactgttttcatgtccatatcattcgttggattggaatgtgagcaacagaatatctgagaaaggaatgtataacataacagcttctggcagactattagtgtaaaaacagcatccaaaaaaaaatggaaggaatatgaatatattactccgctcatccccatcattctttatctttaaattgctactggaagataaaagtatatttattatagtggggataagaactgctttctaggcactaagtgcttggattgtattagccttctattgttggtagcctttctgcctggtcgctcactctgataaattacaggcacggcacacacctgttcactgagtaaaggtcgagtttggaattggattaagagaaaatgacagagaccctcatcacctgagttttatacaccttgaaatggcaatagcatactttttatctcaaagatacaaaggccacgtccattaaaagcagaattttaattgggaaaatattttaaaatgtggtagttcactatcttggtaatgtgtattttcgatcaagacatgaaaatattgtttaagtgtattttgggtaaaagcagggataaaaagatgattccaaatgttgtaagttattcttgtggaatgtttttactggttttcagaactgagatctagtgcaggaagagtctaatgattctgtttcttagaacatttatactgtttagccaaaaagtagaaaaataactgcattggtagtaagccgtctcttttaattataaatgttttctcactgtttggaagctattgaagataacagttattcagatactagtttgctatttgtgcattatctagatcctgcacttgaagctacgcgcaacgtcagtatgcgttgggtagataatgcgtaaaggagttggtctcacattggtcagtttgtgaccttgccagctgttggagagttttaaattaaatcagaacagatttggaatttgttagtgaatttcatctgtttctgatatccgtattgaaatgagctgaattacagtagtgtgctttttgttgtttttgatgtgttttttgactaagcactatggatttgaattttgtgagtgccactgtccagaaccttttttatggatttatttttctaatatttttacactaatttaattagacaaaaaatgaattctatccttttggaaaagttttttttttttttctctttatggctttttgccatcaggaagcatttgttaccaatttcattgaaaagacaaactagtataaagctgtcctggcttttgagctgaattgaaaaacttattttctttattctggatgaagtttctgggtatctaaaaaaaagtaaagcttcttcttttttttttttttaatggttaaatggctgagaaataattcttttgtaatgcatgtataattccctgtcttccaatagaggcttcttttttcctttgaattttgggggaattatatagtaaaatcctttcttgcactccaattacagtgtggttataaagttctccttaggctttggtaaaggtatataaataaaaatggttatattttgacagaatataaataaaattatacaaattatttttatgcatattctgtgttgtttttttttttgacatgtcaggtgggaacaacatggatttttttcccccactctttgttaactaaatagacagatctatatggtttggggattcagctggacactgagtatgactggttaaatcagttctaatttttaaaaaagattagaaaagaataatttatgtaggttatggggcttttttgttttaagcagaaaactttacttttggcttgagaccaaattactgtctttaccatggagtctaaagtgatgtctacttcgtaaacaggaatcttaactaagtggattttttgcctatatatcaattttcaaatttacaaagtgataaatttagaatattcttctcttctgtcattatgttcatcagactgataattatgcttctaggtaacagagttctttctttttgtctataaaacttcatgttgccttttcaaaattgaaaaatatagtttagctacgaacagaatgttgctgatgagatataggaggactaaaggacttaacgagaggcacacaattaagcagtaaaattagggaaccaatgaggtaatatacttgaaaataactgtcatggagtttccaatctgttagtttctctcttgaaggtctttcaaataggtagtgtataccttaggccgggtgcggtggctcactcctgtaatcccagcacttagggaagccgaggtgggcggatcatgaggtcaggagatcgagaccatcctggctaacacggtgaaaccctgtctctactaaaaacagaaaaaattagccgggcgtggtcgcgggcgcttgtagtcccggctcctcgggaggctgaggcaggaggatgtgtgaacccgggaggcggagcttgcagtgagccgagatcgcaccactgcactccagcctgggcgacagagcgagactccatctcaaaaaaaaaaaaaaaaaaaaaaaaaaaaaaaaagaagaagataatgtatgcctttctgcttttgtagttttgttatatttttgtagaattaaaatcaaggaaacccttaaaggagaaaggaagtcacataaagctctctagactgagggataaaggaaaagggattatttaggggaatatcaatttagacttttgtttttgttattgttttaatcagagcaactgttgagttttccccttgtctgaagcagttgagctcacccaaacccaagtggggcagcccttccttggaaggatatgagagcaacgagcgaagaaaactaaacctataccttgcacttagtaaataccaaatagatatttagttagaatgccttccaaccccccacaaaacagatttttaattaagaattaccttaaatccataattttatgggctaatagaagccacatttgagtcccagggtagaaatgtgaacatcaaagctggtatctggaagtatgggtgaataaattcaacagctgattgctgtctttcagcatattcaggtgttaactgaatagatactgaatacttgtgttcggacatttaccacacttattcccctgtatgcagttttgtggacagtgttcaggataaataaatgattgattacctcagttctcactgtagctattttgttagcaaagatagcgtttctgccaagaaacttcattttttcagcatccctggcaattctctctaaattataaatgtcaaagcaaaaaaacacatcgttttcaatgaacagtggaataattgttaaagaattagtcagcatctcttaatgtaatcctgggaataggttcacatctacccaaggaaagacctagaaggaaaaggatgtaaagagggaagacctcagcctcacactgtctttcagtggatctgtggggtgtagatgttcaggccacctagtggggaggaaagccacttgttatggtcttgtgcccccattctttgaaactgacactgtgttctttttggtctcctttccccagtgtctccctctgtaagcccattttcaatcgtatttttaaggtttcttttgaaattcaagaggaaagcaactcttttctgatatcataagtgaaattgtagttactctatgaaacagaactgctgagaagataaggaacctttcaatcacacagacatctttcacatactaaaaacagtgcaaataaaacatagtggaagaaagggcactaaggttttgtgcatgccatattttggagagagggagttcttgctaagattaacataaacactgacactcttaaaatgcattttcacacccccactcatgaggagagattgcattttaaatgggggttaagacatccaggcgaactccagggctctgtaaaaggaaccctaaggctaaagagcttatctgaaatttgaaaaaaagaaaaaaaaatgaagccttctgacattcatctttttttcttgtattagtcataacttgcttttcagctatattttaggttttgaatgccaacctgacatctgttcaagtctgcctgtaatttattagcagaggaaaagacagcagttgctcactagttagagatgcaaaatttctgccttcctgttctccactaagtacttatagatgatacctggatacgaagaatgtaataatttactgaaaacttcaggtcaggaaatttataaagatttttttttaattagaagaataaaatggcttaagaccatgtgatttcaaaaatctctagatcaggatttagagacaaaacatagaccctaaaaaatactttagataactttctataaattgtaatttttttaaccttgaattaatttttccattggttttaaatttttaagttaaatgtatatttgaacagtagttgtgcttatatctgaaagtcaaactgtatgtaaattcacctggcattttgcatttatagacagactttaagaaacaaatcttttggagaggtagtgctgtctacagagtcaccaaatggattagatttcctggcaactacagttgagttacttacagatcaacagttgggtcactacaaagttgagatctaagtgttaacctgagtgcccaccagtaagaaaccggttagaggcaatcttaaaatgatatagctccaaatgtagagacatgtttgtgttaataaaaaatatataaaagcaaatgcattctaaaaatctctaaggacatacattaaattgaaaaaaggtttatggctgaatgtggtggctcacacctgtaatcctagcactttgggaggctgagatgggaggatcacttgagctcaggagttcaagaccagtctgggcagcatagtgagaccttgtctcatttatttatttttttaatttaaaaatttaatttaaaaattaaaaaaagtgtttacttccatggaagggaagctaagatggggaataaagggaaagttttgttcttttactcaattttacctttatgtctgaatgttttattgtatttctaatgtgtgattttaaaagccaacagacaaaagataatatcacagtatgtttcttggggtgactctaccatcagcatggaaagtcagcaggaaacaggtacatccttccgccttcatgaagttttctgtggaggaggagagtgcagggtaaaaggcctggattccaagggctttgctggcagccccttagagggtagacagaacacctatcctatttggtcaagaagagaaaaagtttctccatatataacaaactgctttcccccagaatgttctgcattatagtaatggtgtaagtagtctgcccttcaaacatgagaacatttgcatccaggcctttaggcagccaaggcagcattaaagaagaaagagtgggagcagagcgagctgagggagagcagagcttctgacatttgaggaactgggcgtgaatttgtttttagtcttcaaaaaccattctcttgaggaatcgaattcccatgactcctgaagtgaagcggttggtgttttctcctgcgttactcccatacgtaagttggtgattataatgagggtggtggctaatacttatataatgccagacgctgttctgtgtgctttattattgtgtttattaatcctcacaacaaccttcagaagtagacactgtattgtctccatattatggagcaggaatctctgtctcaaaaaggtgaagtaatgggtccaagacacacagctagtaagtagtagagtcagatttgaacccaggcagtcgagccccagatttcatttccttaaccattacatgttattctcccatgaaagcccatcgtgtaaaaccattttaatgggctttctagcttcacttttttggggacctttgaagcaatcattgaggcagcctttgttctagccaagggccaaccatggcaccattgagattttgagctgtataattatttggtctggggactgggtgtcctttgcattgtaaataactaacttttctagtaatctgatgtgttcaaattgtcatgagctcaagagacatgaagatttggtggtaggctgtaatacctaatgccacttttttcatgtgttttttgtcacgtgttgtagcagaatacaggaaggaaggaactggaatgggtgtgtcagagaagctgtcttaaactgtcaacctggagagggaacataaatgttaaaattaaataatcattaaaaaattaagcaacgtaacaagtgatatcaaaggccagtatttgattaagtgccagatgagcagtacaattgataagccctacaggaactgaaagggaatcacatcgagaagacttcatagaagaggcagagcttgagtaaggccttaaatgctgagcggttttggataggaggagggaaggggatagttgtccatatcctgggaagagtgacagactaaacacggtatagacttcatgacttagaccagtctaacagagctgttgtttggaagaaacaggaaataggattaaaaagttagttttgggttgggttgtggaaatctgtgaggagatgtggactctttttaaagtactgtccctgtttaagcttccagacagactcagaaccttccagacagactcaggtgcttctcctgtgtttccctgcaccttgtatatacttagaatccagctgtgttcttaatgtaattattcatttgcattacactcctaaggcagaatttcttaaccttggcactattgacattttaggctggataattcttagttgtagggcgcctgacctgtgcatcataggatgttaagcgccatccctggcctctacttgatgtcagtacttcccttcctcaccactccgagccccagtgacgattaaaagaaatgtgatgaaactgtcctgtgttgagaaccattgctcaaaggcctttgaaggcacaactgtaatgtcttcttatccatgtattatcaacatcaggggtgttgggatgtaggttgcaggtcattgttggaccatgaaccactgttaccagtccacaataagacaaatattggaaattaagaataagtaattacaaatgtttatagcaatttgacattatcacaatttttttaaaattatattttacaaaaatgttggtctgcaatggattggaaatttaaaaggaaaaaaaatacagctggaccttagcatacatagtttgagaagcactggcctatgtaaatatttgcaaaatgaatgaaattttttgaacagatgccttagagaaaaggtgaggcgaatagtcttagagaccagtagactattgctgtccagtgtgtggtacttagaatctggattggggtgaaggcaacaggaatggaatgggaagaaaatacatgaaaaaattgcagacatgaaactggcagaatttggcaatagttattgtgggtgacagaattggaggtgagactcaggtcttgtgagaaaatgttggaaatgagaaactcaggagaacatagttttggaaaagtagagaatatcattgcacatattttcaatatcgtgaaaggaaactggaagctgaactgaagagaggaagaattactggcatttcaatttattgaagcctagcttcaatcagtctgcacgtgtttaggaaacacactgttgactacttttgcttgaaataccctctttacttggcttttctcactccaagcatttctggttttccttttacctctctggctgtctcttttcaacctcttttgtgtcccttaaaatgttggggttcctcaggagtctgtctttgacctattatttttctctaattattctcctccaaattaatcacatctgtttcatagcttcaattagtatctttatgctgctaactctcaaatatgcatatgccacctcggtctcagtttagaactctggatttgtaccagcataatgtgttgggtatttcatgatcacatagtaagcttgaaattaaacacattcagttgccccctcagtcctctctaaacatgcatctatatctgtgttttctatctctggcaatactctagccaaaaatctggacacctttaactcctctctttccctcacctcccacttccagtaagtcgcagaatagaccgtcaattctgcaatctccgcaatctctctgaaatccctccagttctctctacctcgccctgccactcttccttcaggacaccattatctcttgcctgaattgctccataagccctcagccttgcccttctctaatccattctccacactgtaactggagtgatttttataaaaaggcaagtctgatcctgtcactgcactggttcaaactctttagcagcccgccttaactccttacatggtttacaagccctgtgtgatctggctcctgctaaactttcttgcttcgcctctcagcccgtgcccctcccccatactctgggttccagccagcctgtgctattttcagttcctctaatttgccatgctactttctcttacctctatatcctagggttatttttttttgctttttttttttcttaaccatcttttcatccaattcctgttcactcttcaggccaaagctttgaactcactgtttctagaatgagtaggctttaatgttcctcatgtgtgttctaatagctccatgttattttatgcattattacattgtattataattgcttattacatgtctgtattccaagtcctctctccatgtccctgccctcacaaacatagtataccttcagtaaggaataggccttgtttattttggtcactgtcgtattctctcctcccggcatggtgtctggcttataagttttcaggaaataaataaatgccaggaacttgattaatcttgattaattaaatagaacacttagacagtttgatccaagccctgccctcatgatacttacagtctgtgtgggagtaacactgtatttgcacatcccaaagcagtactgtgtaaaacataaggtgcattgtgaaccagattagcaaagtaggccacatggagaagcagcagatgcatttaaagagcaagactgagccatatctttaaaagtcaaagcagatatgatgtttataattcattactaaatccatgtagatcctcttagattctgaatttaggaaagacctcttggattggtcctgaatggcactaggctccagaaataagaaaaggaagagtattttcttgggtacttgtgagctaccatttgcttcattgggaactgccattcttatgtaagggcactataacaagagtgttcacatttaagggcatcaggtcaatattgcgtctgtgtgagtttgtgtgcatgtgaatgcacacatgtattttctatttttaaatagaaacacattataaaaataatgcatcctcataaaacagcacagatagagtaaaaagtgaaatctcccttcattctacccactccagttttactccctctcttagaggtagacactgtaaagagattggtatgaatttttcaaaccctttcctaagtatttatacaataatatataatcaatccattcattcatttattgagacagggtcttgctctgttgcccaggctggagtgcagtggtgcaatcatactccgttgcagcctcgcactcctgggctcaagtagtcctcccacctccacctgccaagtagctgggactacacccagctaatttgtgtgtgtgtgtgtgtgtgtgtgtgtgtgtgtgtgtgtgtgtttgtgtagaattggagtctcactatgttgctcaggctggtctcagactcctggcctcaagcagtcctcccgcctcagcctcccaaaatgctgggataacaggcatcagccactgtgcctgacttttttttttttttcaacctagtagtgtatcttgggtttttttctgtgataaagcacacagataacattttattttttaaaaagttaaatagtattagcagatctgcatccacacaagtcccgtcatggtaagttagcgtctcttcctcagcagtaagaaggctcctaggcacacaccagaacaaggttggcattgcgtctcctttctactcacttgtatggccctaggcttctcaatgcggcagggccctgggcgctcagctacttgagccttggtacccttgcctgaaaaattgtttattggtaggtaacattaatgtgtgtaagttttctaacacagtacctggctgactgtcaaacactccatggatgatagttacttggtatgattatattgccaagaggcacttttggagctctgtaaaaggcaaaaatttataacccaatccctttaatctaatgttaagatgtgttttcttcttatcttaaattttgttgctgttgaaaatagttaacacctgagattttcctcctatgctgttttataattacccattttgaacagtgtttgttgataaggtagtcaaggggacacttcgaaatattttttctttatttgtgaagtcatactttggctgatttatatttaatttttatcacattacatcggagaggagcagataaattttctatcacctctataaattttctatcacatataagaaagtgtatcttatatgtgatacactaacttggaaaaacaacagctatcttgatagacacaatagagaataggatgtcagaggaagagaagaattagaatgttaacaataatgctagtaaaaagctacccaggacttaaatggtattatttgagagtacttctaccatgattcaaataagacttgccttggaattccatatgatttgttacttagagcagtctacctttaatatgtttaatatggtcatactttaaaaaaaaaaacctgcaagaaacttgggtttcacgtttttgctttttaaagaattaacataatgttatttcaggtttgtaaaggaagttacagaagatagcaataaatcccttccatataccattttagtcatagtgcaaaattaggcattgaaaattattatgggtactgtattagatattcaaagatttatttgtggctttgacttctttaccaacacctctggctttaatacagtatcttttatcagagcaagtaatagtttgaatccttttcttacaaatcctctttttactcaagtgactgcaaacttataaagatgcacacatctgtagcttgaacgtctatgctatttgctcaagtatttacttgaatttatcctcgatgatatgattttttgaagtgctttgattttaaattctatctagaatcccatcatgagggagaaatcttagcaagacttaagcaccttttcataatgactggttactgtaggataaacctataattagtatgttgctaatccacacgttagatatatcccatcaaatttcaaatatacacaggagaattatccacattgaaggttattagtgcattccagggacatttccatgttgattcacaactacccctttaccttacactttcctgtgttactagacgtctctttctgtaaaacttctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaacccttttttttcatgttatctagaaatgaatctttaaaaaaaaaaaaaaaggaatgggttgaacttataatattttagcaactcataaaataacttgaagaaaaagatcatttggaaggagagacaaaacagactgaaagacattgtttaaatttatgacttttattatcttacttgaatgctatttttgcccctctcgctattattaaaccctttgcttcctgttttcagttgctcctgtcaaggtatgaatttttctttggatgattgtcatctatttcatattatctagtattcctctctattatgagaaaatcaaaagtagacagtgtatctatagctatagatttaaatgcactaaggtaattatatatttgaatcagagacctaaggaataatctagtgtagcatttaccaaatttatttaaacttaacatgcttacatgaagacagacctatttatgtttccaaggaacaccagtttgagaaatgctgatcttacctgtgtcattcttattttgtagatgaggacattgggacctcagaagaataaggcaacttatttaggctaaagtcactgcttgtctactggggctggaatccaggttgcttagtctggtgccctttaggcttcatgattcagccacttaagacaatttgatttattgttgggctttttaattctagatttcataacttggatatgaaactgtacttcccagtctccaaaataagcttcactgttttctggaacgtgaattagattcagaaagccccttactgcctttagattattgcagcctccccagtgggccccagggatccaggaaaaatatctttgtttttcacctagtcctctcctcagcttttagagggactcttagatctatgtttatgaaaagacttttattagttcttatagttgtagtaatgcatgtttattgtagaaaatttcaaaaatgtagatgaataagaagaataaaacaatcactcagtgtaaaaaacaaaaaaccctgaaaaagtaccattaatattctggagtatatcatccagctagttttagctgtatatacatagaaccaaaaaaaaaaaaaaaagcattttgctgttttataactggttttctccccactcagtaagttaacagtttttcttaaatattctctacaacattctttattttgtagaatgataatgctgtggtttgtttaatcaatcccctctagttagaaattgtattcagttttttactattatacactatgtttaacaagcaccttagaaactaaatatttctacacattcatatttctttaagataaattcctggaagtagaattgctgaatcaaaaaggattcacaagtgtaaatgtttttgacatgcactgccaaatttagacttcctttttgaaaagtcaaatgttaaggagatcaaagcaatcactaagcaggtactctggaagagaaatagaaatataaaaaatataatggtttcatgagaaactaatagacaaggtttcaagagacttggagtctagttttggatttgtcattgaatggctgtgacttttgggtcttagtttcctcattataaaaatgggaagatagactagaaatagaaactttttcagaatagtcaccttatgaatgttgtttcagtgaaatataaaggtctgtacataagttctgcagggaagatgccatgtatttgctcattcttcaagtttcagcttgattgcctttggaaggtctgtcacacttaacgtcctcctaatagaagtaattgttttactttttggctcctcatagccctttttaaatgttggttctgtatagttgtatctttgatttttaatattgaggtatttgtaacagaggttatcttactcatctcctgaaagcacttggcttagcatagttcttgggtatataatagagactcagtaagtatctgtggaagttgagagtgataccttgttccccagtgtataacagcaaagcctagcctcctcctgttgagcattgtctgttctcgctttgaagagctcaccacatttcttcagtttgtttttgtttttattttattttatttattttttttttttttggcggggtggggtctttcctattcagtaacacagtggttctcagtctttggtgtgtatcagaatttttttttttttttagagttttgctctgttacccaggctggagtgcagtcgtgtgatctcagctcactgcaacctctgcctcccaggttcaagcgattcttgtgcctcagcctcccgagtagttgggattacaggcacatgccaccatgcctggctaatttttgtatttttagtagagacagggtttcatcatgttagccaggctgcccttgaactcctgaccttaagcgatccacccaccttttctggtattacaggtgtgagccaccctgcctggcccagaatttttaatgttaaaaaaaatacagatttccaggctctcaagtacactgaatgtgagtgtcaggcacaaagccgagacacagcgctgtcaatagctgagctctccttggggttttagctttgtcaggcaaattgatattcaagttccaggtctgccacttaccagatgtgtcttccccttaccaggggaaggtcactttaccactgtaagcctcagtacctcttccttaaaaagagggtaaaaataataccttagctcatagttttaaaaatgattacgtaagagaacatattaaaacacgtagtatagcccttcccatatctgcagttctggccttgatctgtaacttcttggatcttatatgcatttattatttatttgtttctttttaaaataacatttatattttttcaacttttagaggttaatatgttcattatagaaaactgaaaaacacaagaggcatataactaaaaaatcatccataacagaatcagtttacattctgatgtatctttccagtccttgtatgtgtatacatatatacataactgagtatacctttttacatggttacacttatatagtatgtgccatgctttcttgcatatcatgagtacttgagtatcaaaatactcagggctttaggattcagacattggtaaatattcacgatacattttcttatcttttgtggggacaaaaatatcttaaaaaacaaaatggcaacaggtctctggaaatgcatattggcaggtttatagttaaatactgtgttcacttaatacccaatataaaatgagatacaaagcagtcaagtaagtataatgcttcttagatagttcagtatgagatctgcactattaaaatattaccagaaatgatgtttctacttaattatttaacaattcatatagtattcacaaagtataccaagaaaaaagcacacatatgtcagtggttataatcagattgtaaatatggacatatctatatatatctcttcccttacctttctttctgccccttccttagcaatccagtacgtactgatgtatactgctcataggtggtttaacattgccatttccaagatgcttcttttctaatgaaattaatttactatctagttaattcactagctctattttatacattgtcacctcataacatctagaaagcttagtgttgtgaagtaaggactgataaacagaggcactttactaaaaaatcacttcctagaactgtggctacaatatgaaactatcttctagatatgaacatacttgcaaagaaccttccttttgcctttcttcttccttcttcagctcaatgaataagtacagaaatgcatatagctctacgagatgggttaacaacagtcactcccagacaacaagccttgctaaaaactctaacaagaggacatttatcaaagaatcattttacttcttaaactttcagcatactttgggcacttctcagcattggggccttgtttgtcctttgcatactcaacaatgctaagtaaatgcacttgcagaacgacgagtagataatctgcatttatctcaaaacacactggcacagaactcttccaccgtcacttcctgtctctcccacctcctttactacccaatgagcaaagaatatgtagctcaaagagataaaagtttaacagttccattctaaagacagtcattcctgttaattgacataaacttacttaaagtgtgttattttgtgaagactacatgtttcaaacgtctactgtataatgatagcattgattaaattgtgtgcatataacaaaggctataatctgaaagtatcttcgaaatatgaatattatagccaagtacacttcaccttctcacttccttcttatcattatcagcccaaaggacaatatcagcgttccaaaagttgttttcagaagatagtcttacctatgaagttttcgggcatacaagaaaagtatataatatgttttagttcatcatctcttcttttgtcaaacattagcaacctctttatcatctagacaacaagatgtaaaattaggacttgcttgttcattgtacagataaccctcaatgggttatgtctcagcaaacccatcgtaagttgaaaatatcctaagttgagagtgcatttttgacttacagtattttcagttgactatgggtttatcttgtcgtaactgattgtaaatcgaagagcattaccaaatgcatattgcttttataccatcataaagtaaaaaaaattgttaaaagtcaaaccagtttaagtcggggaccatgtgtatacactatgtgcacagcaaagtaaaataaaatgcacagaacatgcaggtaatcttgcctaactacaaacacatggtatagaaccctttattccttcctacacttcctttgccttcctcctccctcagtccacaagcacagatctgtaccactcaaagaggaggtctaataatcccatttccgaaagacagtatttcattaaatttattaattccttttatccaggcatttagtggtcatttttagatgacctttaccacatatcttcagatgctttcaccgtccgccataagaatttttactgaaatgaattcttgaaatgtttaaaactttgttacattctttctcgttccacaagtagttatcccttcccagttacctttcttttttaggtctgtggagtcatgatacatctatccccttttcctttgtttttcatgcatttgtcaaatttattattgaatactcctaaattttttctgcctttatcatttgttttttctttttcattgctttagtcagttacccttgcactacagcagtagcctctttattatcttccttgcctttagtcttcttcctttccatcctggaatatttatttcagagcttactgtacaaaaataccagattctatcagagaacatcaaaggaatcacagaatctcagtattgcaaaggatcttagccatctagtgcacacacctgttttttatttgaatctcttctacatttctttttattattattattattattattattattatttttgagatggagtctcactctaatgcccaggctggagtgcagtggtatgatcttggctcaccgcaacctctgcccccctggttcaagagattctcctgcctcagcctcccaagtagctaggattacaggcgtgcaccaccatgcctagctaattttttgtttgtttgattgtttgtttgtttgttttgagatggagtctggctctgtcgcccaggctggagtgcagtggcatgatctcggctcactgcaagctccgcctcccgggttcacgccattctcctgcttcagcctccctagtagctgggactacaggcgcccgccactatgcctggctaattttttgtatttttagtagagacggggtttcactgtattagccaggatggttttgatctcctgaccttgtgatccgcccgccttggcctcccaaagtgttgggattacaggtgtgagccaccgtgcctggccttttgtatttttagtagagacgaggtttcaccatgttgcccaggctggtctcgaactcctgaggtcaggtgatccacccgcctcagcctcccaaagtgttgggattacaggcatgagccaccgtgcctggccttttgtatttttagtagagatgaggtttcaccacgttgcccaggctggtctcgaactcctgaggtcaggtgatccacccgcctcggcctcccaaagtgttgggattacaggcgtgagccaccgtgcctagccttttgtatttttagtagagacgaggtttcaccacgttgcccaggctggtctcgaactcctgacgtcaggcgatgcacccgcttcggcctcccaaagtgctgggattactcatgcctggccctcttctgcatttctgctgagtaacttctgccaggttccttaggctaagcttaagttcctccagtgacaggaatctcactccctcctaaggctacattcctcttttggacaactataggtttaagtttagtcttccttatgttaaggtaagatgtatttgcttgtatcttctcctacaagctctggttcttcccctgaaactacacagaacaagcatgatactacttctttatgaacactctttaggtatgaagaaagctattgtccagacttccctacagattcctcttttctctaagctaattctcctaagcttggttggttttttctagccagtctttttagccctttaccatcctattcacgtttctgtgaactttaacatttatgtatattaatgttaagctgtgaaacctagaatttagtggagtaatgcaaatgtggtctctgttgtaaaatagatcagaactatttattctttatttaaaacactagtcctttaatgtaggccgaaattgtgctaacatttttgacatcgacattctatcttaatgcttatctagtttactaatgaatgaaattcccagtcatctctcacaaaactgtatctcccccagctgtactcaagtacagaaaacatctattcttgataacttttatcttgttagaatagctcttttctcttctatagctacaacttgtcagtgtgtccttatcagcttatgatttaattgaggctatagaacatatacacttaaaaaaaataagctaagaactcttagaataaaacaacataatgtattgtcagttgtaaccatgaatgatgtttttcaaagtgtgtcctctggcctacattagagttacttagggcgcttgttaaatattcagtttcactccagacttaatgaattcagatttctaggagtgatgtctggaaatctgcattttaacaagctccattggacattggtgcatattaaaggttgacagctgctactctaagtactgaaggattgagcccaaagatatgatcagaattaggtggcattaataaaggaggtgatttctggggacagaagaacatgaactgttagagtaggtagaaattccaggtgtagtaaagaagaaataaattgtctgctagggaagatatttgctaggctgaattaggggcccaatagaacagcacataaaaggagttaaaagctaagggacggaaggaaaaaaaacaaagaaagaaaaaactataaaattctgaaaccagtaaagatacatgctgccatttggcagcaaggcagacctgctatagaagaagcatgatctttgtcatcaagaattcatgaaataccaggcaacaccctatgagggaatgtaaaagggtgggggtgtcagcaaagattagtttggagcattgctacacacatctcatctttagttctaggctatctaatgagaaaatctatattaaatctaagttgactgatttggatatagaccagtcggatggtagacagcttgcacagctgcttggtgctcaggaaataggctgttttcactagcatagcaaaactcagagtgctcttggcattttgaagttggtgggacaacagcaagtctctaccagacagaatagtgccacgaaaatggatggtcaaagtcctgactgcccagatggtatcaggagtagtggtcttggtcttaagtatttccatttcttaaagatttcataagtgcacagataaacaagtgtagatgacaacctattttagatgttgattgagagtcttaaggccaggcgtggtggctcacacctgtaatcccagcactttggaggtcgaggaggctgatcacttgagcccaggagtttgagaccagcctgggcaacatggtgaaaccccatctctacaaaagaatacaaaatcagccaggcatggtggcatgcacctgtgatcccagctactcgggaggctgaggcggcaggatggcttgagcctgggaaatggagattgcagtgagctgagatagtgccactgccctccaaagcctgggcaacagagtgagaccctgtctcaaaaaaaaaaaaggtttttgaaacaaaaggccctcctatataatgagtcaatgaaagttatgctcttagagtaaataattatattgtactactgaaatggtaagtcaagtagaactaagaaaatactcatgactctagttccaatttacaattttcaacagaaccataagagaagttgtaattatggaaacttaaatgatcaaatattaatttgtgtccaggcgcagtggttcacacctgtaatcccagcactttgggaggctgaaatgggtggatcacctaaggtcaggagttcaagactagcctggccaacatggtgaaactccatctctactaaaaatacaaaaattagctgggcatggtggcacctgtaatcccagctactcaggaggctgaggcaggagaattgctagaacctgggagacggaggttgcagtgagccgagattgtgccactgcactccagcctgagcaagactctgtctgaaaaaaatataataataataattatgattatatttaaaagatcaaatattaatttgtgattatattttctacaagggcatgcactatttaaaattgagcactcaaatctggtttgcacaactgcacagagaagcttgcaagactgccgaatatgtcctgacttgctactagtcttttgatagcctccttctttggcaaacatggctagtctgcatttgtactggaagccacttgggattcctctttaaacatcagtcattgttcaaaacccacttcgcacttctttctctctttatagatcatgttgcccccaaaatgaactgaacactcttatcttaatgctaatttgacagagaccacttctaatttattatcatcctgcttactcttatataaaattagtgtttgctatagttttttctccctttgaatacctcaaagttgactgacagtttttcctcaacgcagcttgcctctgataacatccagaaaaaatgaagaaaatatactgctttgtaaaatagaagagcttaacaagtacaaatttgtcacttttttcgggtgtttcgaaagagtgtaaacagtaaacattgctgtttatttcttgtgtttcagaagtaaggctatgtatttttatcgagctatttacaatttacatataagatgtaagtattttcatgaatcattttcatcagtggggtggatatacctatcatagcggatacggtcctattctgacttttagatcagaaatcactttcagttatttgtagcacacaccttaaagcctattaaagttctccccaccaaaatttgtattattataatcactggatgtcaacacctgtggctcaaacagtatccaaattttgtatattgttggaggattgctgatttaactgagagttgtagctagaaataaggtgagaaagaatatacaggtaatactaatccacctcaaactaagaagcaaaggatggtggatgggctatgttgatctagcgttgcaaaaacacttttggatgaagtgcccagaaatagccccagttcctttcactagaatcagctcgtcccaggtgaatgccggcagagcagggtgtgtgctccccaagaaagggcagtgaccgctttccaatgtctggcagttaggggcgatgagagtagttgcaattggcaagataaaggggaactttggaaaataaatatacttatgatagaggaggcaggagaaaaggtcaagggctgtacacatgtggaactgataatcatggtagcttggcttctatgaatgggtacatgttgacccttaagtgagcttagaaagcttgagaaatcagtatgcgtgaactgtttgaggcataagaaaggcaggattttaaaactttttttttaatttgtgcaaatttatgggatacatgagaaattttttacatgtatgtaatatgtagtgatcaagtcatggtattcaagggatctgtcaccccagtacaatatattcttattaagtatagtcatcctaccctgctatcaaacattgaatttattcctcctatcttactgtacgtttgtacctttagcctacttctccttagcctcccttcatccccagtcaccctccccagtctctgttgtctacttttccactctctacctccatgtgttcaaattttttacctcctacatatacgtgagaacatctgatttttgtatttttgtgtttggcttatttcatgtaagataatgatctccacttccatccatgtagctgcaaatgacataatttcattgtttttatggatgaattgtattccattgtgtagaagcaggcagaattgactctgatagtagtctagctggaagagaggctatagctacaaagaatcttgacttaccaaaacactagtaacatgtctgtgaaactgctgtagtctaactcatttactactatgttaatttggagcgtgaagttcatcagtggaatgggtactataatttgcaaagttcaagtgacaattctggtagataaagttttaaggagcagatggtcacaactgtcagtctcagaagtaatttggtaagtaaaatagtcatttatttggaagttttttggtaacctaattgtgatctaattgtcaccagttgggagtctaattccattttcatcactcatctgcagaaaggtgagagaaataagctattaattaatagccaatatttacgagctcttactatccaccataaagtatgctaagtgctttatgtgcattatacttaattatagtaactttctgaggtagttactattattatttccagctagttagtggaagaaccaggatttgaatccaggcaaactgactgcagagccctcacttttaacactacacataaaactgagtttatttaacagaaaacactgtcctttaacctgagattgtgtctacctttcaatactaaaatgtactttttatatgaaatggtggtgatagacgatgtcaggtttgattttcttttttttttttttttaagaaatctttaccttgcaaaactaaaactaaaacaacccaatgacagcactgctctccagtttaaagaaaacaaatgttcttttgctagttgtgaaatctaaatttgagaaccactgactagaaaagtgggactcttagtaatttttaaagttctttagagatttttcacctgatttattttctgatttcaacctccttgttttcattaaccttttccttaagtccacctcagccactcattcttcgattatacacaagactttgtttgccattaccagcaaccacaccactttggggatctcagatgtaagcatcttgctctcgcgctgcctcccatttttccttgcttactcctagcatttctcctgttaccaactccagcaacttggaccccactggaacctccagtataatttattctatcagttcccaatctttttgttctctctctcctctttccccagcttaacctccatggtctatcacatatatcctctttgtatacacctttagcagccttgctcctcatcttctgttgtcaaatccacaagtgtttctcagctacctgcctactctgtgccagtattctcgctgttaagcatggcttaagaaaaacacaaaaccacagtgtctgatctcactttaaatttatgaaccaaatctcaagtgagccctcagtatttcttggaacagatattcctagtattccttctgtatttccctagtccaatccatttattctcctattctctgagatgactagttcttcttctctatttggctcaacccccaagcaccacctcttccatctttaccagcagctgatgacctggaatctttacttcacggaggaaatagaggcaaacagaagagaacttcttcatcttcttcatcttcccaccacaagatgtatgattggttgaatgagagaaagactgtgatgtcctagaacttcagttgctcctatatccaatgtaattagcaacttaaattccaaaaccatatataaaaatcgatttttggccatttgagattatactctttactaccactttcctttctcttattataaccaagagttgttactatgtttgtgcctcatccaaataaaaagtaggtattttttagaaaatgattaacgggagcaattagtaaaacaagcagtaaaatacccggatacaggaaattgagccaggcttgctggtatgtgcttgtcccagctactcgggaggctgagttggaaggatcgcttgagcccaggagttccaggttatagtgagctgtgtcacaccactgaactctggcctgagtgacagagtgaaaccctgtctctaaaaaagtacttgacataggatattgagagaagaaatgctttggaactatgtttgattatacccttagcccaccttagttcttacttaagtaagttatagatgaaggagaaaagatgggaatcactttgaagattaaggcctcaaactttgtggaaaatggaggaaaaaatgttgaaaacagtcatgtgatagtttttaccttacacttttgatgggaaaattagataatagaattgagctatacgtatgttgactgcacattacattaatttaatcctgttatttacctcatattgctaacctttaaaattaagatttgaaaaaaaagagatgggtaaaaccaaaaaggtcaaaatttgtatgccagcttagatgaaatttgtatttatagaactgaataagaatctacaccttacctaatactgtgaattgcttatgtaaatacaacaaaggatggtccctcgatgacctgaatctcatatgctgagttcacttagtaacagcgtccgtctgctcagacacattttcccaactccccatgtgctttccaaacctttaccatgtttcccagtatcctctcttcatccctcattttgttgatgacctagttcctgcttcacatagtcaacagaacccaacaggaataacctcagctttcttcctccttgtccctttatttaactggtctcagaaggagaggtgtctttacaagctctccctctccattcctcctctgttgccaaagtttctgaaagtgtggtctccatatctgcttatgctacttagttttcttctaagtgaaaggtagggactcaaccccaaatgctctgaccctgttcgaagaccctgtggcctagagcggcatgtatttcctgatttctaaacctagtgccctttttccaggcctcatcctctatcactgcagcatttatctctgttgtcacattcttctgcttaaaacttttcacagcttttcacgtacccagggcaggcattcaaaaatattgaagcagtagttttgatgtcttttctgagctttcaccagtatttttaataggcactactgcctaaatgtcaaatgccttatagccaaaaacaagtaatgatttcctgtaatctccaaactgattcctcttcctcttgctatgtcttggtatccctgaggttaccatcattttatccatgtacccatgctagatgcctcaaggtcatccttgactcctcttccttctctggtttccatttggtttctaagctttgatgagtatctcccgcatcttcttttctttttctactatttcctatgactcttgcctctttctgtttattgtcttttgtctggattatttcagtaatatgttcaggagtttctaatttggattccatggatggacctcaaaggattaaagaactctctcaaatttgtatgcaaattttttgtgcatgtgcattttcctggggaggtccattagactgttctgtgggaaagagaggaatagaatgagagacaatgacaatttaaatcaggtccactgatttctcgttctatacctggcctttgttatttaggtcactaacctaaggcacttatctctgaggagtgaggtggcatgtaagatattaagaataaaacagcagcattagtcagtccagctgggcagtcagtccagcagccagagatcagaggctcctcaatatcagatccaggctttaatatcctagagaagctcaggagaaagctggggcatcagcaggagcagagggtgtcctcccgaggcccctggacccatttgttcctgtgcttccaaaggacttagagggatatgaaaacttaactggcaagaatccagagtgagttggtatccccagaaaaaggttcagaacattcccccagctagcctcccctcctttgcctgtttggtctctcgttctttctccactctgccaacacagttagcttttaaatacatatctcctggtgtgccttccgtgattgtcacttacacctaagggtgattagactaatcacccaaaaatgtggggttttaatcacctatgaaacaagttaaaaaatcatggtcatggtttcaaggcctgccagttaggagcctgccagcctcgtcgccaggcactgccctctcctcacttccagggctctggctacagcaggttactactggctgtttcgagagaacagtgtctgtgtccatatccctatgcctttgatcatgctagtctctctctttggggtggcatttcctctccattgcctgtgaacctcctactcattcttccaggcccacaatggatgttagctcttcacctgagtccattcttaattttctgccatcactctggcagaatcagtatctcttggctagagtccaaaaacatttcatacatatctctgataatgtcatattatattgtagatagcctatttttatttctgtctttcctactaagccagaaatgccctacagctagggactgtctttttcatgtttgtatccctaacagctacctttgcatctagtctaaacatgagcttagtacacttttgttgaatggaattagttataaagagtttttatgactcatttaaaattagagaccaatgcttacttaataagtcagaataggctgtaataataatagtaataataaagtcccatttccactgcttattcaagtaacagcttcctttgtggaagtacattttgaaagacttcacatgtcagtgtatatttttgatgtgctcatttgagatcctaaaagaattatagttctaaagcagactagagcttctattacattcctgttgaagttatattaaatatattctatcgtttcacatatctgtattatatataataagttgcatgggtaaacattttatctcttttaaacttcatggtaataatttgtgaattgtttattttataatatctgagtaaatttagttcaaaacacattaatttgagcattttctgtgtacagaagcatagttgcaaagttaagattcttgtgtttatgttgttttgttaaattcggaaagtctcagtcttgcaaatgtattttttttttaagtatttaaattagctcagctatgagaataagcacggtccataaattaagagcttcaaataattttttaaaatccttcatattctttgagttttgtaggaaaagaatcaacagtttacttattcagcctttcctgaagtccatagtaggtgctgggcatcatgctgggtgaatgagatagtacttgcatttgaatagtttacagtcttatagcgaagaagccatgtaaacagagaattgcaatataaaccttggaggagaggaaggaagactactttgagaaccgagattaggttgagaatggatgagtctgctgatcaatttatagataaagaagcagagaggtgaagtctttttttttttttttttttgatatgtgaaataggaacctaggttatctctaagaattcatagcagggggtagctcttgagaagaacagtgaagatctggataattaataaggagaattagagatgagctaacaaagacaagtaaagagtggcatgagaaagcagtgagcatagaactgaaactggatagcatgaaattctggaggtatcagtcagtagcacagtggtataattttctccagctgtgctatggagaaattatacacattgtggccaatgtgtagtgaataaagccatattgtattcagggactatggggtggttataacagaaatttacaaagaataaatagttaaaagtccttcaaagaaagcatggcttactagggaaggcagtatggttaagaggaagttgataaacttggagaaaatgtagaagtcaagaagttggagatcagaagggctggtgctttgtaggaactcagaaaatcttcattttcttctttctggatgtcctctccctatgaatgtttcaccaccacaacctgcctcagctacagtttatacatatgaatagtttcaaatcatgatggtaacagttggctcagagggcaagattaggagccagacttcaacgtgctgctaatccagcgtgtccctgtaacttagatgctggtagtgcttggtggtattggcctctaggagaagctcaaggcttctcctgttatctccctaccactcatacttggagggtgagtcaaaggccaaaaagcattttattgggcagtggttcttagggaagggatttactctgtgatgcagagggttaagactgtaagccatcaagtgtttcccctccctctccatgttcaaccaaaggcacagttcttattactttcaaggatttaaaaaggagtcttttctcagcataaaggaggaagtgaagaccaattttgacagcccaaagggtcttcctcctcagaatctaaaatttctaatagagttgtttgcatcttgtgattttacttgagtcatcaaatgtattgtactttttttcttaaagatatacttcttaatgctttcatttcagataaggacaaaccattttccatggcgacacactatttatattgcattttcagaaatttccctttttacccatacttaggagtgtgacactgaaacctgataatctattatttcacagagtgcttttttgggtgtaatataaagatattatataattttaataacctttgaggtacaagtggtttttggttacatggatgaattatatagtagtgaagtctgagattttagtgcaggacccattgtccaagtagtgtaaactgtacccaatattagttttttattcctcactcccctctcactttccccacttcttaattttctgccatcacaatgtgttgcccaggctggtttcatgccctcactttccccacttctgagtttccaaagtctattactctgtacacctttgtgtacccataacttacctccctcttgtaagtgaaaacatatggtatttgattttccattcttgagttacttcacttagaaaaatggcctccagctccatccatgttgtagcaaaagatgtgacttcgttctttgttatggctgaatagtattccatggggtgtgtgtgtgtgtgtgtgtgtgtgtgtgtgtgtgtgtgtatacacatatatgatatataataattatatataatttatcgttatatgtaaaacaaagcaaattttttatttttatagagacagggtcacaaagtattgcccaggctggtttcatgctcctgggctcaagtgagccaccacacccagccaaaaataagtaatatttcccagttagacattttcagagtaaaaagtatttgttcaaaatcatagcatgaatggactcttccagagacctttaactggcagcatttccccctcaaactttagtacagttataggaattgtttctggatttttggctgtatattcttgttcatggctcatggacattaacatatgtgaatggcatcactgtgtttttcctaaagtgcatacgaagaagaaagaacactttcctttagagtcttacttagattctagttagctgatataagactgttttcttttccttttcaggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggagggtaatgtgaacataagtgtgatttagtaaaagtttatcactcgctatacgatgaatgagacccagagttatggagacaaacttgttgctttgatttatattttgaagcaacttacaggtaaatttacctagtacctaggttatatatggcactgcaccagggactgtggaagatttacgtgatgagcagatgttgttgcccacatattcctataaacaaaggtaggtgattgtgtaagccagaggttttgcaaaaataggtcatgaatatattttcaggtgacacttttattccatattgcttccagagacttgtgctcatttatcctttggaagaaaaggggaaattaaatccataaatagacttatgaaatcgtattatgtaaggttcatatgcaaaaagctatcttacttaacactgagtcttgctcagttatagagtgacaggattgagttgtcagagctcaaaggaaagcttgatttgcgtctcagaaatgaaattatttaaaaatcaagctagaatttactaattctgatagttttacatgtcaacttgactaggacataaagtgcctaaatatttggtaaaacatttcggttgtgtctgtgaggatgtttctggatgaaattagcgtttgagttgatagactgaataaagcagattgccctccctaatgtgggcaggccccattcaatcagtttaaggcctgaacagaacaaaaaggcttactttcctgcaagtaagagggaatttcgacttgcctggttaccctgagttgggacattggtttggatgcacaccgaaacatcagctcttcctggcttggaggcctttgggctggaactaaataatgcgtattagctctcctgggtcaccaggttgctgacagcagatcttgggacttgtcagcctctgaaattgtagatttatcccaaggaattggctaaaacgattatggaggctgacatatatatgtgggtgtatatgcatacatacatattcatagagatttatcataaggaaaacacacacacacacacacacatacacgaacattctattggttctgtttgtctgttctgattaattatcctaatactaacatatttttttcattgacagtttaagaacaatgccatgagatttctggttctagcaatgcagtagactaggtaaccagaaaaccttccttctataaacaccttcaaatgctaggtatacactgtaccccttaaatatgcacagttatgtgccaattaaacacaaaataaaacttttaaaagttctgggtaaaacataactgaaatcattttaaatgcataattgagctcttcagaaagaaaactggatctccaggaaattagagtcgtgagatacgggctgcagcttttggtttcataatgtatgggtttgggttttagtacccactagggaacagaacatgagtccttgaatccatttacagtgtggactaggaactggtaccttcaaaggggttgtgtctatgaaaagagtggactagaaaatatctgctgccaccacagggaaattaacaaaaaatatttaactgcctgggttctggaatggaagctgggaaatctcctatgggaattcttcttcttttttttttttttttgagatggagttttgctcttgttgcccatggtggagtgcaatggcgtgatctcggctcaccacaacctccgcctcccaggttcaagcaattctcctgcctcagcctccccagtagctgggattacaggcatgcaccaccacgcccagctaattttgtatttttactagagatggagtttctccatgttggtcaggctggtctcgagctcccagcctcaggtgatctgcccgccttggcctcccaaagtgctgagattataggcgtgacccaccatgcccggcctcccatgggaattgtaaaccatggatccttgttcatgctggtttagaatttgaatgaatgtatgctacctatgtggcttgaaacccgaagctgagaaattagttaaaaaaattattcaggtgcagtggctcatgcctgtagtctcagctacttggaaggctgagatggaagggtcactagaacccaggagttctaggctgcagtgagctctcattgtgccattgcactccaacctgggtgacagtgcaagaccctatgttaaggaagaaaaaaattagtcctgggctagtgatagcataagttgtcagatataagcaaaccccagggggtgctccaacaacctaggctgaaaggaatagaaaaagtagtcatgaaaatttaaaactcagcaaccaagtttaagataagacaacaaatttcagctgaagagagaagtggtaaacagaagaataaacctaaagaaatcacccagaatgtagcacagagagataaagggatggagaagatgaaagttgagatgagagagttaaaacaagaagtccagatagaatagtgtagaggcattattcaaaaagagaatgactaagaatattctagaattaataaagacataagtactcagattcaggtagcaccatgagcctatatgggataaatgaaaattaacttatttctagacttgttataggagaatgccaaagaaaaaaaatcttagtaacaaaagaaagacatggagatgacttacaaaggggtatccattatgttgatagcaaacttttccatgacagaaagagagaacaaaaaacagtagaataatatcttcagagagctaagtgaaaataactgtcaacttaaaagttaatacccagcttaattctcattcaggaatgagggtgaaataaagactttttttcttcaggcaaaggataatagaattaactagttgcagaagcttgttggaagattatgaagcaagatgtactgagactgaaggaagttgaacccagaaggaaacagtagagccaagaaacaatgatgagcaatgaaattggtgaaaatatagataaagtctgggagttctacttctagtagtggcaaattaggtcatttgagtcatgtgttccactgaagactaccagaaaagctcaacacaatatttaaacatgttttgcttgaaggtatcaaagaagaaaaatggaggcctagaacaaaggtcctcctggtatactgggtcactgttcctctcgagatattagccagttctgcaggaagctgctaaaacctaagcagcccttttgacaggctagtgggagtaatgggggcagagattagtgcccatggcccctaaggaggggacacctgatgaacataactcattttgagtcaagaccctgaagggctacaccataggagcaagggttaaccaggagtagacatactctcactgaggctgcagatcagctttgaatcatgtcagtccctaaaattagattgagggttcctaaattgctagtgcccctaggcatctggcagaattgtaaatccttcctggaagaaagtggtatcatgtaaggtcacaaattgtttctagtttgcaaatgcaatgtctggcttataatcaaaagcaactggaaacagatacacaaacaacatcaagaagaagaaaagatggttcaaacagcctctagatattggaattctcagatacagacttttgaaataattatacttaccacattcaaggggataaaagacaagacagatttttggcagagaactggaaactaaaaataaacaaatataaattctagaactgagaaaatcagtaagtaaaattaactcaagtgaatgagtttaaatagcaggttagacacatctgaagagagaattagtgtactgaaagatataagatgaaaataaccagagacaaagaatgaaaggaattaagagagagtaagagagagagagagagagagagaataccgtttaaaggtctggtgcgtgtatttaaagttccagaaaggcaagagaaagaggatgaatcaaaatcaggatttgaagagaaaatggtttagaactttctaaaactgatggaaaacattagtccataaattgcagaaatgatatgaaccctgagcaggagaaataccaaagaactctacatatataggcattattgttaaattgctgaaaaccaaaaatgagaaaaatcttaaaaggagctagagagcaaaggaaaattaccttcaaataagcaacaactagctagtagctgtcttctcaatagaaatgatggaaacaaaaagtcaatcaaaggccatttttaaagagctgaaagaaaataactgtcaacttagaattttatatccagtaaatggatgaatgatcatagaaatatataatggaatacaaggcagtaatgaaaataaatagcctacagctatatacagttgtgaatctcacaaataaattattgagcaaaagaaaccagatttcaaaaaacacatactgtgtgattccatttatagagagcttacctaaagtatagtgtttaacaacacatgcttgggtggtaaaactataaaggaaaatgaattattaccataaaaatcagattgtggttacccatggggaaaggtcagggaggagtgcttgggaggggttgtgaggaggtgctcccaggatgctagcagtattctgtttcttatgattacgtaggcgttcattttgtgacagttcattgaggcatatattcacattttgtaacttttctctatgtgtgatgtattttgcaattaaaagttttaaaaataaattttaatagcattcactgagaaaaacaataatgatatgaatatttttaaaggatagaactaaaatatggaaaaaaacgtttgggaagtagattaaattcatgtaagctccttatattattggggaagatggtagggagtttgagaccagcctggtcaacatggtgtaaccccatctctactaaaaaaatacaaaaattagttgggcttggtggcgcacagctgtaatcccagctactcaggaggctgaggcaggagaattgcttgaacccgggaggcggagattgcagtgagccaagatcgtgccactggattccagcctgggtaacaaaagtgaaactccatgtcaaaaaaaaaaaaaagaagctaataatgttagttaacattaagtcaaatgtgcatgtgaaagttgtacattgtgcccaaacttttccaaagcatagggaggagctgggaaagaaacagtggaaattcaaatactttagaaggcaagaaagaaataacaagactcaaagacaatgtgatgataataaaaaggtaattttaaaaacaatttcatttatagcagaaatcagaatgtaaagtgcctaggattcgatctagcaggaaatgtgcaagacctttaaggagaaaattctaaacatttttgaaaatctttttttaagcagctaataaatggtaagatataacatgttcatgtatgggagaactgacaatgtcataaaaatgagttctgcccatcttggtctgtaagttgagtgtatttccagtgaagcctaataggaattttttaacatttgacaacttgattctaattttttttgaggcttgaagagttatgagaattttgaagaataatgaagatttacttttatcacatatcaagacttactagaaagcaatagtaattgaaacaatgttatatattcatgcaaaaacagaccaaggaaacaatagaacacaggaaggaagagcctgctctatgacaagtgatgatacagatcagaggggagtaataggctggctgtgccttaaacggagctgagataattgactacctatttggaaaaagataaaatgcaattcctacctcacagcatacaaaattgcaagtggatttacaaaaaaacaaaaacataaaagcctactaaaatttataggaggaaaacttatttagaagaaaaataggcaaaaatgttttaagatttgaggctagggaagaattgatacagaaagtaaatccattggaagtgttaatttggctacattaatataaagaaaattctgtatgacaaattacactgaatacaaatgtctcaaactgggagaagatatttgcagtgtatataatctacaaagaattggcatcctctataataaattctctataaaaagtcttgtataataagaaaaatataaataccacaatttaaaaaaactgtcgaaggatttaacacgtagttctcagagaaagaacacaattgaagaaaagcaaatgaaaagatattcaggaaaatgtataataaaagagggattatttcttaaacaacctggcaaaatttacaacagctggtaaaaccaagagtttgtggggttatggagaaacaaggtctcatatacattgctagttggagtataaactagaagaatataccaagtgggtagtatcttgcaaataaatttgacatcttacaaaaatgaaaatgcacaaaccccatgagttctacttcaagaccactacctatgataaacaacatgacatgtaccaggatgttgattgtcatgctatttgtaatagaggaaaaagaaacatcattactcttccttagtaggaaatggaatagcatacagatattaaaatgaatatgctgagcacagtggcccacgcctgtaatcccagcacttcaggatgccaaggcagaggatcatttgagcccaggagttgaagaccatcatgggcaacatagtgagaccccacctctacaaaaattaaaaattagccaggcatggtggcacattcctgtggtcccagccacttaggaggctgaggtgggatggtcacttgtgccggggaggtcaaggctgcagtgagctgtgatagtgccactgcactcccgcttgggcaacagaatgagaccctatctcaaaaaaataaaatgaataatagatttacatagatcgacatgaataacactcagaaatataacatctcgtcttcaaaaaaaaaaacctagtaagctgtactgaattaatctatcctaccatttaaaatttttgttgagggtaaaataatattaaatattccctttatagcaatcctcttagtgctttaagtctgcttgttgggtccttaattgtttcaattttatacaaggtcgtttcctttcctgctttccagcatttcattaagttcttgttcaggtctccagctagatcagtctcattggttctagcaggtgtgggtcttggtgggttggtgcaagtccattcactatttcaactcttcagaaagtcccggaaccagtcagttttgcagttcattcctaatactaagattgtttctgcttcacttatctttttaacttacctcagtgtaccaagaaaaacagtcatcaccatatactatctaggttgaataaactccgcttaaaaattattttagattattttccaaataatttacaaaatacaagaataaagagataaaaaactattaaaaattaaataagaacttaaatatataaataaaatttttatgccatgtttccctggtcttgaggtgttttggattttggtttttggaatatttgcatatacattaagatatcttggcgttgggactctggtctaaacatgaaatccatttatgttttgtatataccttgtacacacagcctgaaggtaattctgtacaatattttaaataattttgttactgaaacaaagtctgtgtacattgaaccatcagaaagctaaggcatcactatctcagccactagatgtggatggtctgtggttggttggcatcaccattgtttctgagtgtaaatttatatgcctgataaataatcgttttcatacatgtattgagacacaagtacttaacagtaaaaaatatgacacaccattaatacagtgaaaaaatagtgagtttagggtaactaagcagcacaatggcatcaccagaatacctggataagctgttaaacaacagcaacaccaaacagcaacagtttcagtcaccacctacgatgttgtggggggcttttgttttggtttggttttttgagatggggtctcactccatcgcctaggctggcatgcagtggcaccatcatggctcaccgcagcctcaaactcctgggctcaagccgtcctcctacctcagcctcccgagtagctgggactacaggtgtgcaccaccatacctggctaattttaaaaatctttttgtagagacaaggtctccctaggttgcccaggctggtctcaaactcctgggctcaagcgatcctcctgcctgagcctcccaaagtgctgaaatgacaggtgtgagctaccatgcccagctgatgttgtgttttgattaaaagattatcatacagtaaccccctgtgtgtggtgcacctttcagattttggaacattttggattttgaatttttggattagggatactcaacctgtataccccaaatgggcaggagcctctgaatgcagtaactgttcatcagctgtcctgcatgaacttacaaatactgattctaagtttcaaatacatctttgttggcttctaaattattattacttctggttcttcttgcacttacagcatcaaaacataatgctttaagaatttttttgagatctttggctcctaattttgttgaagagaggatgaccattatatgttccacagttgcaaaacatttttatttttagatttgtagatacctttcagaatgatcaattctgttttttatggtcaatccaattttttaatgtctacttcatctatttcttctggctatctctctgtaatacctgccttcagcatctgtctacttttaaactatatcaagaaaatttggtgcacaaatgaaataaaagatgaaagaatactgtcatgtgtccttttagcaaaatgggatggcctcatttcttgtcacaagatattccacaaagaagactttctattgaataagtaactgaatgaaaatgctttgtccttagattaaaagtatattattcactcattgattcttgagtttgagaaaatgtatgtagggcatcatcatctgaagacacatagactgagattttacttataatcatcaatttcagcatctttattagagtcctaagtgctcctatcttattctttgtgttcaacttctgactcatctaataattctaaaacagtttcctcagattttcttcgtcattctggctagagaacttacaaatgttaatgcttaatcgtattcaataaaatgtagaatgaggtcacaaaagatgttagctccagacttcttttatgccttcttgaaagataacacatatcttgcacaacacagtaagaaaactgaagagtgatgtcatagtgatacttgtttcactgtttctaagtaatttagtcattttttattatactttaagttctgggatacatgtgcagaacttgcaggtttgttacataggtatacacatgccatggtgactggctgcacccatcaacccgtcatctacattaggtatttctcctaatgctatccctcccctagcccccccacccactgacaggccccagtgtatgatgttcccctccctgtgaccatgtgttctcattgttcatttcccacttatgagtgagaacatgtggtgtttggttttctggtcctgtgttggtttgctgagaatgatggtttccagcttcatccatgtccctgccaaggacatgaactcatctgtttttatggctgcatggtattccatgtgccacgttttctttatctagtctatcgttgatgggcatttgggttggttccaagtctttgctattgtgaacagtgcctcaataaacatgtgtgcatgtgtctttatagtcgaatgattgtaatgggattgctgggtcaaatggtatttctggttctggatccttcaggaatcaccacactgttgaaacagcatggtactgttaccaaaacagatacatagaccaaaggaacagaacagaggcctcagaaataatgccacacatctacaaccatctgatctttgacaaacctgacaaaaacaagcaatggggaaaggattccctatttaataaatggtgttgggaaaactggctagccatatgcagaaaattatacaaaaattaactcaagatggtttaaagatttaaatgtaagacctaaaaccgtaaaaatcctaaaaaaaaccgtaggcaatacctttcaggacataggcatgggcaaagacttcattcttctattttcttattttaatcctttttaagcatagttgagaataattgatgagtaatgatgtaatttctagtgtgatgaaatagcataatgtgtcttagattcataaaaagatctagtagatccaaatggcaattgtaagatagaattttattctatttttttaaatattgggttttttgttttgtttgtttgctctttggaaaaaggaaaaaagtcatgagatatcaatttttataaatagtactacttaaaacagaaactcagaaactgagattgggtctaacggaccctaatgagatactgaggattaaacactaggcagaagtgagttaaaatgccatatggagaagcattttataacatctcagttgtgatagttaaccacatggctgcataggtaactttggtgctgtttttaaagttgcaagcaatttaaatattaaactactgatgataaaattgagttagcaaagaatttccagttcgatattaattatagccagccttttcagttatacctttctcacatccagaaatggcttgatgtactcagctaatgacctcatgcaggatatatatgtgtgttacataataaagaaaaacatcacttctgtaattttggacagtccacactgacggagatgaacacttgcatataggtcaaactagttaaatatagaacagccgcttttgaaagctgttgccagggctcaacagcgtcagctctgtttctatggagaaagactttgcagatgttaaaaacagagctagaagccaatgaatggaagaggattgtgctgtggaaatttaatttttttgataaagggtttattgatgaatcagctatattagtctgtgaacgttaatcttgacatcttctttacccaattcccaatttcttggaataagatcttgcttttatttaagtaacacacaatgtaaaatttgatgttattgtactgactaggtggggtaagggacctgatgacaggtaacaagattagtaaggttctgaaaaggtcagaattgtactgaattatgtttagaacagattgcctccgtgatcatttaatcaaacagtgttcgtattgtctttgtccttgtccacatacgtgatttttgaggttgggctgagaaggaaatcatgattccatcaacaacataaggcacattgacagtaaaactcatatattatagcagctttttgtttcatgctgtatagggcagacaaccttgaagaaaaaaaaaactttaaaaaataatgtaaaatttcacagtttttcagtcacaaacagaagtatccttgttgtcactgaagatgacaagaattaatatcctgctgtatagaagtactttggcaaagttaaggttgtagttccaattcctcatttccaattttttctccagatggaaagatgaacagtttttggtattgaatttttttttaggaagcaagttatttatcattagatatctattcagtaaatgcaatgatacagaaaaatgaagtttttttccctcagatttgaaattaggttttaaaatatggagggagaacaatttgtaagtaatgttcaggaacaaaaataaaacctaatgaaactttagaaactttgatggacatctgtcatcctacatacaattgcattaaagaatagaatttattattattttatctggtttattatgctgtaaaatgaatttttctctttttgtatgtagttttatgaaatttcatacatgtatagattcatggaaccactgtaaaaatcaggatgtagaacatttgcatcacccccaaaaactccttcatgcagtcccttactggtcaccctttctttttagtaaccctggtaactaccaatgtgttctccatccctgtagttttatcttttcaagaatgtcatataaatggcgtcatacactatgtaacctttggggactggctgtcttcagcataatgcctttgagattcatccaagttgttgcatgtgtcaaacatccctttttattgttgaatagtatttaattgtgtgggtgtactatcatttgtttatctcttgacccactgaaggccaattgggttgttttctagtttggggcaattatgagcagagctgctataaaccaagtagtggaatttttaggtcatatagcattttatctattttttatttaaaaatatatattcagggtttgtttttgacccagttgaatttccttcaggtcatttttggaactctttcttcctatgtctgatgtaacatttcatctttcatctttgtcatttttttattcccccttttcttcagattactataggtatattctggtattgtagcccagaatctgtcctgcttttatattcctccagcttaattatatgatccatcttcttacggtatctacggcttgctacaagactattctttactatttgcagaagacgttcagatgtatcttgctatccttttttattcagttgtgtatatcttgttctctatttggaggcctttccaaatagatgtcttgttaactctttaatcttatcatgctagaaacaaacaaacaaacaaaaaaaattcccttgtatcttttcccttctgcagcttccttatcatactacagggtaatttcttttcttcactgtcagtcttccaccctacatgcaagcaataatcaaatctagcatttgctgtttggtcatcaccactcctgtcaccaaaattctcattctgtttagattctgcttgcctcatttatgtaccattatttgtttctcactgaccttccaagtgcatactccttttcatcctaaagccaagaataaaatcattttatataaagagcattctactttgcagttcatttactgatgtcctctgtttcagtaggaaggcctaattctagatttcagtctgtcatgatagtactataacttctgcttctcacattaggtaaattttattatcccttttataggaccttgactgcctctgggccttctgttcagttgaacccacatgcttctaacttcttagctattagaccctctctttccccttttatatgtctttgttttggtacagcttctcatacccaaaagcaggtatacctgttagtaaggaggatacaagttgtatttgtaggtggtatgattgtctacctaggaaattcaaaagagtcagatttttttaaaaacttagatattataaataagagtaaagtagccatatataaaataaatacataaaaatatatttccttcatacttctatactgtttctgaaatataatagaaaaatcccatcacaattgccaccaaaaaacatagctaggaatctttatgaaggaatgaaggaatttaaacaacaaaaactataaaactttattgggaagctgggcccaatggctcacgcctgtaatcctagcactttgggaagccaaggtgggaggatcacttaagtctaggagttcaagaccagcctgggcaacatagtgagaccttatctctaaaaataaaaataaaaataaattttaaaactttactgagagacgtaaaagtgttgaataattggagaggcattattcttctaaaaaaccaaatatgctatacagattttagtatttcctaaacttagatatttaacctaatttcagtcagagcttgggtttttgtctgttctttatttttttatttttaattggtggaggttattccccctcataagaatgattctgatgttcatttggaaatacacatggttggaaatagccaagatagttatgaaaaagaagaatgtatagaggagaagagcttcttcaatgtactactgtaaagttatggagataaaaacatgaatgaatccattgagcagagtagacaggctggtaataacctagcatacatcaaagtccaaaccttggtatgatggcagctcagtcaacgaagaaaggagggataatttagggaacaatgctgggtcggttatttgaagaagaattagttggcttctcactttacttgtaccatacacaaaaataaaacaccagataaagaattatatgtaaagcaaaaatttaagaaaagaaaatatgtgaccatcagtgtctgtaatggggaacaattttaaggataaaactaatgaaaatatcataaaaataaaaattgtgctggctgtttagtagaaacagaaaacgccttccacttaccgaaaatataccataaataggctgggcacagtggctctcgcctgtaatctcagcactttgggaggccgaggtgggcaaatacctgaggtctggagtttgagaccagcctggccaacgtggtgaaaccctgtctctactaaaaatacaaaattagccagacttgatggtgcacgtctgtaatcccagatgtgagaggctgaggcacgagaatcgcttgaacctgggaggcggaggttgcatgagcagagatcataccactgcactccagcctgaacgacagagcgaaagtccatctcaaaaaaatatatatacttatatatatgcacacatgccataaagaaaagacaactggcaaactagaataaagtagttacaagtataataatggccctaatgtataaatcattttttaatcaataggaaaagctcttgaatttcaacagaaaagggtatagaagacatatcaaatactaataaaattaccaatggtaaaaacatgattttttaacagcaccagccccttcagtaattagataaatgtgatttaaaaacaacagaaagatactattgtccatctatcaaattgagaattacttttaaagtgtttctaatattcattacttgtgggaatataccaagataggcactatcaggtactgtgctgggattatagattgataaaacctttctggaaaagtgtttctactttttcaagtgttcctatttcaagggccttaaaatacttaacacaccttttaacctaacaatttgcctttagcaagtattcatctatattgtcaagcgtttaagtataaaagtgttcattgtaggctgggtacagtggctcacatttgtaatcgcagcactttgggaggttgaggcaggaggatcacttgagtcctggagttcaagaccagcctgagcaacatggcaaaaccccatctctacaaaaaaaaataaaatattttccaggcgtggtagcacgcatctgtagtcccagccactcgggaggctgaggtgggggattgcttgagcccaggagtttgaggctgcagtgagctttgatcgcaccactgcactccagcctgggcaacagagtgagatcctgtctctacaaagaatgaaaaaagaaaatgtttattgcagcaacatatataatactaaaaacttagaaataattaaatatctaacagtaaggaatgaatatggagtaggagagttaaactgtgaaaccattcatatgattaaatattatagagctattaaaaatcatatcatcggccaggcgcggtggctcactcctgtaatcccagcactttgggagggcaaggcaggcggatcacaaggtcaggagatcgagaccatcctggctaacacggtgaaacccatctctactaaaaaaaaaatacaaaaaaaaaattagccgggcatggtggtgggcgcctgtagtcccagctactcgggagtctgaggcaggagaatggcgtgaacccgggaggcggagcttgcagtgagccaagatcacgccactgcactccagcctgggcaacagagtgagactccgtctcaaaaaaaaaaaaaaaatatatatatatatatatattgtatagggatgggaaagggtttaaaataatacctgtactgaaaaacaggatgcaaggtattacatagctccattttggctgagtttgagatgattgtgatttctttattttttgctattttcccacattttttataattatatattttgcaattggaagcaaaaataaccattgaaaatcgttttcaaagaataatattcaagagaatacaaggtgcagtaagttcttaatatttagttaaaatatagaaatctgtggaccattaacagcacttatctttaggtaatgtaatgatgttttatagatgggtctttattgatgggatgtcactatgttgcccaggctggtcttgaactcctggcctgaagcagtcttcccacctctgctttccaagtagctgggattacaggcacaagccatggcaaatgtagtatattttaatttatgtttttagtgatggaatctcactgtgttgcccaggctggactccagctcctgggctcaaggattcctccagcctcagcctccagagtagctgggactataggcacgtaccactctgcccagctttatttttacactttatttgttttacaacttttgctctgttaacaaatctactactcctttaaaaagttaaaaaacattctcttattaaaacaaagattaggctgggcatggtggctcacgcctgtaatcccagcactttgggaggctgcgctgagtgaatcacctgaggtcaggagttcgagaccagcctggcaaacatggtgaaaccccgtctctactaaaaatacaaaaattagccaggagtggtagcacatgcctacaatcccagctactcaggaagctgagacaggagaatcacttgaacccgggaggcagaggttgcagtgagctaagattgcgtcattgcactccagcctgggcagcagagcaagacttcatctcaaacaaacaaacaaacaaaacaacgattatatccttatcagagatttaatggatactaaccatatttaatcctcagtctcattatgctcatttaatttttattatccgtatgttgtcatatttaggttatgttcattttttaccagttttgttaatccctagtattttttgtttttgagacggagtctcactctgtcgcccaggctggagtgcagtggtgcagtctcggctcactgcaacctctgcctcctgggttcaggtgattttcctgcctcagcctccagagtagctgggattacaggcacctgccaccacacccagctaatttttgtatttttagtagagatagggtttcaccatgttggccaggctggtctcgaactcctgacctaagttgatccatcctcctctgcctcccaaagtgctgggattacaggcaggagccaccgcacccggccgtgttttttgtttataaaagaaaaaatttccagagtgcactttactccctgataggagactaaattacttaaatataaattttagaaggtacgtgttaaattaacctaatgaattagtagcattcagaagtgtttgtatctgttaaagattcaaaatatacaaactaatttcttttaatggtgattctatttctagtaaactaaggcagaaatcattatgcagaagaaacagcaccctgttaaccatgttctttttataaaccgtctctgttctcactttattgttaggaaggcgtaatctgttttcatgtaatataagtacatgtgagtcatgttgagtttcttcactcatttgtccaattcccagtcaacctgtaggtggagttaacctttagttacataatataacgaaacaaacattaaacctactgcttctgggacagtcttctcaccaaaactcagggaaaatgggagggtgttgccactgactgacttaatgaaagtatctgacaaatgtaaggtctttcaaatagtgagataagaaatgtatataaattatttgatcgactacttactttctatctatacacacacactatcagtatataatgtgtattttcattttatagctattaaatatgaggttctagaatgagttttcagtttgcagaattctgagaatctagttccaacacctttgagaggacaacaaccacaattgcacttgccatatttattagtcaaaatgaagcgaagtcaatctgttgaaagctttgttttgtttttctgattagtttgtttaataagacattcaaattatgatctttaatataatttcttcccctaatagcttggtgctaacagtggtttgcacatcatcatctttgatgaaattgatgccatctgcaagcagagagggagcatggctggtagcacgggagttcatgacactgttgtcaaccagttgctgtccaaaattgatggcgtggagcagctaaacaacatcctagtcattggtatgtttactttttaaaaaagtactattcattcaaaaacgttagccataagttctgaattaagatgtgtgtaggttgtgattaaactgttttgccagtgtttccaaattagaatccagtgatattgaagaatctattgtaatgcctaggcttaataggaaaaataaaagatggatttcagtcacttgtaggtttaagcttatagctcacccacaggtgaaaaagatgtaggttgaagcttatagctcacccaaaaatgaaaaatacacatgaaacaatggaatgcagtggttttcaaactgggtcttgcaggccttcgggggtcctcagaggtgctttcagggtcagtgagggccagggagtgcgtttcagatcctacatcactattataacttcctcttttagctgttttatgtactgaggtgcttctgaagatgacttctgggggaaaaaaaaaaaaaacaccctgctgttttatgaagtctgaaaaccactggcctgtaaaaaagagaaggaactttggagtcagagagatcgtgtcacattgcccctctgtcactttgacagattatttaccctttgaatcttaaattttctttttaaatactggaagttttcataacatttatattccattggcttatacagtagtgaaatagtaaagcaaagtctccttagcttgttagggaaattactattcttacatatactaaaaggacatttgattttatttttgaactctgatcatttgttgttttgttttaacatctgtgttcaggaatgaccaatagaccagatctgatagatgaggctcttcttagacctggaagactggaagttaaaatggagataggtaaggagatctgtcactgattgggtgtgtggtggggggagtggaggcatttagagttcattaacaggaacaatgtcatatggtgtagtattttttagaaaaggtttatatcatgagaagtagatgtttacatgcttgagtacctataaggaaaacattaggatcataataatctcctctaggctgggcgcagtggctcacacctgtaatcccagcactttgggaggctgaggcaggtggatcacttgaggccagttgttcgagaccagcctggccaagatggtgaaaccccttctctactaaaaatacaaaaaacttagccgagtgtggtggtgtgcacctgtaattccagctactcggaaggctgagataggagaatcgcctgaatccaggaggcagaggttgcagtgagctgagatcgtaccactgcactccagcctgggaaacagagcgagactctgtctcaaaataatagtaataataataatgataatctcctctgatggtgctttcgagactaggaaaatgcctattttatttttaatttcatcaggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggtcaggaaaatcagctaaacagattataaacattatgccagtattctttctctttcctttcaagcatatcaaggggtagggaaatgctgacttttggtggagaagagatggtaaaaggaataagaattaattgtcaactgctaaatcttcagagtagcaggaaggaagataatgtttgcatctgccctgtagtaaccactgactcatctaccttaggtcatcaccatctgacacagacacgtaaagtgaaaattttgaagaagtgtttttaaatctttgtattgtattaaaagttgtaatatggccaggcatggtggctcatgcctgtaatcccagcactttgggaggctgaggcgggcggatcacaaggtcaggagatcgagaccatcctggctaacacggtgaaaccccgtctccactaaaaatacaaaaaattagccgggcatggtggcgggcacctgtagtcccggctactcgggaggctgaggcaagagaatggtgtgaacccaggaggcagagcttgaagtgagctgagattgcgccactgcactccagcctgggtgacagagcgagattccgtctccaaaaaaaaaaaaaaagttgtaatatgtcagaggaagtgggagtttccacgtactagaattttgggggctgctttattcagcaaatatattgaatagttgatgtgttcaagctattgggctggagacataaagataattgtgaactcttccctcaaggagttcagagtcaggaaaatggacatattttcaaattagtacaataatattgtagttaccatggtagaaatacgtactaggatacttttattttgataaagtgctcttgatcttccatctcttctctcctttaggttttagttaccacctgtagacagatttactgaacatatctgtctcctactttcagatttgtactaaataccctcacctagatgttttatcaggtctcagatttaatattgcaaaaccaaatttattgtcttttttactactttcctttctgctcgcatttccctgtttatcccaatttcccaggcttaaaacatcaggattatctttgattcctggcactctactgtgccctaggtcaagtcacttgccaaattttttcagttctgtcttggcagtgccttttagttctcactgccactacccaccttctctttgattaaccttcctgtatcatatcattcaaccattcagacactttcagtgattccccatcatttacaaaacaaagtacaggcttcttttgggtcttttgggtcctctagatctgaccctaactggcctttccaaatgtgctcctgattattctccacatacttcagccaaacttaaataatcaccggtcatcagacattaatttatttttcaacatctctgctttggttttgttttttttgcatcactgaggatcttcatcctctacgtttacctgtcttttcaaaacctggctcatatgctaccactgtcctcacaccttttcacattttccctttcaagaatgttatacccgtttccttcttgaaatagtaatgtatcatttatggtactgtcagttgactttggttcacagtagatttattcggcatctactgcatgctagaccctgtgctaggagttaataccccgactgcaaagaagtaaagtacctaccattaagctgccctcagtctaaccctccacgtgcagtaacagaaagtacatgcaaggcaagagagtgaactcgtgtcagatatggtcaacttgtggggtgagagaaaccttcatatgcatgtctgttggtagagcagggccttttaggtagagggaacaacatatgcaaagaagcagagacacagaatagcatagtgcgttggagtagtttagtattgcttcagcatggaagttaggggagggatggtagagagattgtgggggataagtcaggagactaaagtagggatggagcacaaagagccttttatactctgctaagaagtatggactttttttctgtgagtagtgctaagccattgagttttaagaatagcagtgacatagtgttaaaacataagatcactctggcagctctgtcgagtggagtagttagaggagtggagttggcgacacaggacaagagggggagcttttataacagttcaggcaagaaataaaagcctgaacagttaggttgagtatgtagatatttgggtatatcctatcactggttctagaccaggaatccagccaactaccagtttttataaataaagggcttttttggaacagtacacattaatttgtgtactgtctatggctgcctgcatgctacagtggcagagttgagtatttgcaataggggctgcatggcccacaaagcctattttagtgcttttattttaggtactatctgccactttacagaagtttgctggcccttgttctagactttaaatccttatcttattcacctcagagtctcccatagtaccccagatagatctaaataatgagcacatggtaggtgtccagtaaattatttttctttttttttttttgaaacagagtcttactctgtcgcccaggctggagtgcagtggcacagtcttcgctcactgcaacctctgcctcctgggttcaagtgattctcctgcctcagcctcccaagtagctgggactacaggcatgtgccaccacgcccagctaattttttgtatctttagtagagatgggttttcaccatgttggccaggctggtctcaaacccctgacctcgtgatccgcccgcctcagcctcccaaaatgttgggattacaggtgtgagccaccatgcccagccaatattttttaaatgagtaaacttacgtaactattctgaatcacgctctatccataagtcataatttccctacataatagaggtggatttgttctagctcaagaatgccaaaggtttggatggtgtgggaatattgtattgggtctttatataatggatccattcagggactatgtttttattcttccttgtttgtttgttttgagacggagtctcactctgtcgcccaggctggagtgcagtggtgcaatctcggctcactgcaagctccaccttccaggttcagccattctcctgcctcagcctcccaagtagctgggactacaggcacccaccatcacgcctggctaagtttttgtatttttagttgagatgggatcaccgtgttagccaggatggtctcgatctcctgacctcgtgatccgcctgcctcggcctcccaaagttttgggattacaggcgtgagccaccatgcccggccatgctatactgttttaataagaagagatggcaacttcaagaaaaatgatgtaaacagtgtgaaaactggtccctaccatactgatctttcatctcagaccacatgggtgcatcttgatgtaatccacagtaactagtttactagttgtcatatttttcatatgtgttggccatggaatttttctcttatttagtcatctgtcattttaactacaataatcctatcccaaaatttcactttaagccgttgtctcagtaagaaacatgctttcttcaagcatatattgggtttatctacatatgaggcaatgagggatggtgggaagatcgcagatatcgtagtcagaaggtgtggttatgcattatatttcttccacctttttgtttctgacctgtcaaggggagacactacctatctaatcagatttttatgagaatgaaagcaaatactttatataaaagtgccttgtaaactctataaatgctagttatctccatttttttaattggctgatttgagaggatatcagtacttttcaatatatgaatttctgatttttattgactctttgtagttacacattttctaattgtaaagctaaaatgtttgtcacccttgtacataatatattatccttctgatttgcaagtaagcagtagtgcaaatagttcatgtttccatcacttttttccacatgatagaattatctgtaagcttcaggtgatatgtattgacttgcgatcattgctccttgtaccaaacagctcctaacttttcaccatatcaatggaataactatgtaggcactttagggatgagaaagctatgtaagacactaaccttacccccaaaaagaaatattactaacatttcatcttctgcattttaaaaaatctgcattgtcagaaggtctttaaagactatttttccaatgactcgtccttggctaaacaaaagaagtacagttttagtcttccattgctatagatgtttgtagctttaatagtgattgatgaataaatatttaaattgaaacttataaagttgttactgaactttaaaacattcaaaacgtacaagtgttatgatgttctttctttgtattttaaaaatccattattggtgttattttgcttccttttcaaaagattgaggcctaaagaaagatttagtcaggtggactaaacaggtctttcctgttaaactgttttttcaggttttctgagacaagtggaaaatctggtcagaaacacctgttgttcatgtcatttatacttgaacctatgattgcggtcaactaaaattcatgtgacatttggttgtttttatcttgaaaggaatttctgcttcaggttgagaagattcataacccaaattttttctctaatctgttgtgaggaaataaactgaggacacacacacacacacacacacactttctctcacatacactttccacctgagtcaaagctctaagttatgtttacagaatttcataaaattatttcttatttttttgcagaatttttgattgattaaggtcattctacccttaatttaagaggaatgataagaactttgaaaggtcagatttaaaaggttatgaaatttaagggtgaccacttgatatttgctagtgttgaaatacaagtttattagtttctgcaggtataagctgaaagatgctgcctcttctatattgattagctgttataaataaaatgcaggaaaaatgttgctaattcaaacaaatgagaaaaggttttctgaaaaagtaaaaattcagaattatagactttttaaaattttacaaattttgataaaatgctaaaagtcagctaagagcagtccttagaaaatttattttaatgagcaggtaggaataattgacaattggaatattgatggcttacaattatgtaacttacagaattccttatgtgcctgaaaacagtttgttttgaaatacttcttccccacacccatcttaattcacttttaagaaaggactcagcaattaattgggtgagtcttttcttaataattagcaaaatgacaagttttataccagcttcagtcctaaaatctatcgtattttttggcaaattttgaaagatgggcaagatttttctttcatactgctgtatgtatctatcatttgaattcggttttactgtaagagaatcagaatgcaaaatattatggtaaaaacctaggcctgtgtaggaaagaggtgtttaaagtgaggctggtagctttgttgagattttaatgtttcggtcagagctcttgtcttccctttggcctgagagtttgtatcttgtagaatcctttcagatgtatcaaaaagtttgaatcagagttaaaacttttatataagggtatctaggaaggaagtcctgtatctgccttttataacttatggaaacccccaggtttgtataagtataaaatgagataatgtgatatggtgaaatgagatagtgtgtatgaacatactttataaactataaagaactgtagacatttgtatattattaattatcataattctttcacggatatgcttgtttcctgtgacaccatttttctttttttcttttttttttttttggagatggagttttcttcttgttgcctaggctagagtgcaatggcgtgatctcggctcaccacaacctccgcctctcgagttcaagcgattcccctgcctcagcctccagagtagctgggattacaggtgtccaccaccatgcctggctaattttgtatttttagtagagacagggtttcgccatgtaggtcaggctggtctcgaactcccgacctcaggtgatccgcctgcctcggcctcccaaagtgctgggattataggtgtgagccaccgtgccaggcccatttttctttttttaaacttagaaatgccaaataaatgcgattaatatttatcaaacctcatatgtgccaatataagccctattaataatttaaatgtttatgtttttttgtttgtttgtttttgtttttgagacggagtctcactctgtcgcccaggctggagtgcagtggcgccatcacaactcactgcaagctctgcctcccgggttcacgccattctcctgcctcagcctcctgagtacctggggctacaggtgtctgccaccacgcctggctacttttttgtatttttagtaaagacagggtttcactgtgttagccagtatggtctcgatctcctgacctggtgatcctattgcctcagcctcccaaagtgctgggattacaggcgtgagccaccatgcccagcccaataatttaaatgttaattgttctattgaagtaaaatatttgtctctttgttactttttactttatttttaaaagtatagaagttatagatgatggctttctttttgtaaaagattcaagaatgtcaaagcatatagggaaaaatgagaaaggccatctctaacaccactttcctttccctctccagagttagccaaaatttgggatatatctttgaagtttgttttctttatataatatttacattcatatacgtatgtgcttttttaaaaaaatgaacattaatggaattatactgcagtttacatttttcacttgcaaatattccttggatagctttctgtgtcagtgtatgtaagtccccttcattattttggacaaatgcagagtattctagaatattgccacataatggaaaatataagatccatgaacacagggaccttttctgttttatttactgctatgactccagttcctcagatagtgcttggtgtctggtaggtattcagtaaatagaattaatgaataatttatttaacatatggattatttctggttgtggctgttgaaaaaatactgttgtgaaaatgcttacttgcctccctgtgcacacaaggaatcattttctagggtagccatccaaatgtcttttcaaagacatggtttcattgtcttctagtttctagtgttgccagtgagagttatcataccaatctcgttctggtttctttgcaggaaacctgttttgtccctcagaaaggttctaggactttctcttcacctttggtgctctgaaagtttacagcagtgggtctggacagatgtgtgcttcttttcatttatcccgatcatcactcactgaaccctttaaactgcagaggcacacctttcttcagctataggaaatttttttctcttctgtcttttattgtttcttctctatgactctttctgttctctccttctgagactcctgttagatcacagttaaaacttatggatatttctttcatgctttgtagcctttctgtctcactttctgtcattttgtgggatttggggcggaagggaagataaataactgtgttctgtttgccatcttcacccagcttcctgccatagttctttttatcccacaaggatgacttttttttatatctgtcacttcatttgtctcacagtctcttcctaaaaaaaatatgactcatatttcataataattgatggaaggttgatatttatttaacatgcgtttgttttatagtcagctttttttgaaaatgctttttttttcaaagccatgataccaatttaaaaattaggctgtgttgttttgtgctattggtagtgagcccagtcgctttaaaacacgtgttggtatcttaatcactcatctggtccaggcagctccaagtgctgataaaggccttgatgcttctccagatgtctaaatgctagctccaggtgcagtaagcagactatttggagctggcacatagattctgaagcacaatgtattaatacaaatgaaagttttaggttcttggtctcctagagtaatggttcttaagcctggttcagtaccagaatcacctgtggtacttggtaaaactataaagaccctctaataggcctgttaaatcaaaatcccgtggggaatgggactgagcgcctgtatatctctgaaggctctggaggttattctgatatgcagccaagtatggctgtgttttcatttctgtatatattttctttttgtatggatttttcactgttcttactctctgtatgtattttttcttactcatgcctcatgagttaaaatggctatacagtgtcccttggtacagatgtgttctaatttacataactgatcccctcttggtagacattattaatatgcttcccatcttttttcataacaagttactttagtagatatacttgtacatataactttgtacacatttgtgaatatatttaggggataaattactagaagtggacttgttcagaggatatatatatttgtgaatttgagagatgtgttttctttgattccaatttttaaaattgttttaaaatgcccataaaattgtccgggcgtggtggctcacgcctgtaatcccagcactttgagaggccgaggcgggtggtcacaaggtcaggagatcaagaccatcctagctaatatggtgaaaccctgtctctagtaaaaatacaaaaaattagccgggcgtggtggtgggcacctgtagtcccagctactcgggaggctgaggcaggagaatggcatgaacctgggaggtggagcttgcagcgtccgagatcgcgccactgcactccagcctgggggacagagtgagactccgtctcaaaaaaaaaaaaaaaaaaaaaaaacaaaaaacagaaaaccataaaatttaccgtgtaaccattttaaatgtacaattcagtggcattaaatacattattaatgttgtgcaaccatcactaccattcatctccagacctcttttcatcttgtaaaactaaaactccatacccataaacagtaactccccattccttcctctccctatcccctggcagccaccattttactttctgtctcttggatatcagctactccaggaacctcatataagtggattgtacagtatttgcttatttaacttagcatatggtcctcaaggttcgtcatgttgcaggatatcagaattttctttctttttaatgctgaataatattccattgtatgtacgtaacacattttgtttatccattcctctgtcaatggtcatatggatttcttccacattttagctattgtgggtaatgctgtcatgaacaaggctgtacagatatctcttcaagaccctgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaactgaatatattcttaactattcttaaatcttggaagtccttacattttgtttttatctcttcttaggccagtactaaagtggaagtggacatggagaaagcagaaagcctgcaagtgacgagaggagacttccttgcttctttggagaatgatatcaaaccagtgagtatgcccattgagtgatatataggccaaaaagtaatgataataataactcaggcgaaaagtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcactcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcatgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattgcacactccttatgagaatctaatgcctgatgatctgtcactgtctcccatcacccccagatgggaccatatagttgcaggaaaacaagctcagggctcccactgatgctacattatggtgagttgtataattagttcattatatattacaatgtaataataatagaaataaagtgcacaataaatgtaatgtgcttgggctgggcatggtggctcgtgtctgtaatcctagcactttgggaggctgaggcgggcggatcacgaggtcaggagttcgagaccagcctgaccaacatggtgaaaccccatctctactaaaaatacaaaaattagctggatgtagtggtacgtgcctgtaatcccagctactcacgaggctgaggcaggagaatcgcttgaacccaggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagtattttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctcccgggttcaagcaattatcctgcctcagcctcccgagtagctgggattacaggtgcttgccaccatgcttggccgatttttgtatttttagtagagacggggtttcaccatgttggctaggctggtctcgaactcctgacctcaggtgatctgcctgcctcggctttccaaagtactgggattacaggcgtgagccactgcacccagcctcagatttaatttttgccattcagttaggtgtaaaatgagatctcatttcagtcttgatttgcattttagttattagagaacttaagcatttctccatatgttaattgaccatatgcatgtattgtgtgaaatagtgtccaagtcttttgcctgtttttctgttgtactgcttatttgattgatacaagttctttatatactctttttttctcaattttgtattgtgttaaaatacatataaagtttaccattgtaatcattttcaaatgtatagttcagtggtattaagtatattcataatgttgtataatcatcaccaccatccatctctaaaactcttttcttcttcttgaactgaaactctatacccattaaataataactcttttttccctcccctacaacacctggcagccaccattctactgtccatctttatgaatttcagtaatcttaagtacccatgtaagtggaatcatagtatttgtctttttgtaactagcttatttgacgtagcataatgtcctcaagggtcaaccatcttgcagcatgtcagaattttcttcctttttaaggctggataatactccattatatgggccaggcgtggtggctcttgcctgtaatcccagcacttttggagattgaggtgggtgggtcacctgaagtcaggagttcaaaactagcctggccaacatagtgaaaccccatctctactaaaaaatacaaaaattagccaggagtggtggcacacacctgtaatcccagctactcgggaggctgagacatgagaatcatttggatccgggaggtggaggttgcagtgagccgagattgtgccactgcacgccagcctggtgacagagcaagaccctgtctcaaaaaaaaaaaaaaaaaatccatgatatgtacataccacatgttgttatccattcctctgtcaatggcagccaggcttctgccacgttttggctattttgagtaatgctgtcattagcatggctgtacagatatctcttcaagaccctgtttttagttctttcgggtatatactcagaagtggaattgctggatcatatagtaattctatttttaattttttgagggaccaccataccgttttccacggtggctgcaccattttacattcccaccagtggtgcacaaaaattctgacttctccacatgctcaccaacaaattattttctgtttttttggtagtagccatcctaatgaatatgaagtgacatctcattctagttttgatttgtattttcgtaatgattagtggtgataagtatcttttcatatgcttatcaaccatttgttacatatccttttttttttttttttttttgagacagtcttgctctgtcacccaggctggagtgcagtggcacaatctcggctcactgcaacctctgcctcccaggtttaagtgattctcctgcctcagcctccccagtagctgggattgtaggcacccatcaccatgcccggctaatttttttgtatttttagtggagacagggtttcaccatgttggccaggctggtttcaaactcctgacctcaagcgatccacctacctcagcctcccagtgtgctaggattatgggcatgagccactgcacttggccaccatttattttatatatatatatatatatatatatatttttttttttttttgagactgagtcttgctctgttgccaggctggagtgcagtggcgcaattttggcttactgcaacctccgcctcctgggttcaagtgattctcctgcctcagcttcctgagtagctaggactgcaggcttgcgccaccatgcccgactaatttttgtatttttagtagagacgaggtttcactttgttggccaggatggtctcaatctcctgacctcgtgatccacccaccttggcctcccaaagtgctgggattacaggcatgagccactgcacctggcctgttatatattcttaacaataattatttgttccaagtatctcctttaaagacaaaagccaatttggttagccctgtctttttattactattgtgacttttaaatataaaataatcattttcaaaagtaactccaagatttttttaacaacaagtaatttggccatgaggaagtgacaactaaaaacttaattttatttattccaagggtctggaggataaaaaaaaaatgaaattatgggatatgtaaggaagatatacacgttatatatcttgggagagtcactgttttatggttcaggcatcttaaagcttctgctgtgaggcttggagtatataactggaaaaattaaagacaaaagccagcctataatttttttttttttttaaatgagatggagtcttgctgtgtctcccaggctggagtgcagtggcgtgatctcggctcactgcaacctccgcctcccgggttcaagcaattctcctacctcagcctcccaagtagctgggattacaggcacacaccaccacacccagctaatttttgtatttttagtatagatggggtttcaccacgttggccaggttggtctggaactccatacctcaggtgatccacccgcctcagcctcccaaagtgctgggattataggcttgagtcactgcgcccggccatgaaaatttcttagaacagccatttagccagtttggattagtttcatcattactttttacactgctactgaatttgccatatctaggccaaagaatgagaaccttcctctgtattcaggaatcaaaggaccagtatatgcaaagagactacgtaaaaagtggtctgaaaaattattttgtggcaaagtaatagagatatgagatcactggatactgtttcaaagacagtattacaaaaacagctttatgtgaggtgcatgttctaaagaactattaaaactattccatacatcaggtaatcaaaagttgaattttgagggatgtgatgatctttaaaaaattgaaattctcaagatacatgatctttacatgtacatgatctttacatgtagtaggttatgttttcctatttattctgttaacctcatgaaaatccagttcaattgtaaatactaaagttattgactacttttggcagctgttttgatgggaggtataacctttgagattaaaagttgacaatgaagaagggtgcaatttaagctccaatatgtagtgaacacaaatagaattattatctgaaataattgcttttatatccttcttattacagctcctcatttctatctcatcctaaatcttatatttacacatataaacttaacattggtgccatttaactatgtcccctaccacaaagttgatgtgaacatgatcttctcattaccatttcgtattctcatgttaatccatagcacctgcagtcagtgttaaggtagcatatttgtctattgcgctgtttctaagtccataatctcttttttcctttgttcttaacagaacagcctcaaactgcatactgttgataaaaataagcacattggaacatattctttctctcaggaattatgagggtttgagtctggtggaatctcagcctagaatccattgtttttattccattaagtcacccaaagcagctttttttttcctattgggaaaaaagttaaatgagaaattatacaagttgttttgctttccaggctttttatattaatatgggatagtgatcaatacctttagcatgtacgaattataactcgtcttttatactgttagtttttaacactaaggctcaaaatgctttagactcctttttcttaataggcctttggcacaaaccaagaagattatgcaagttacattatgaacggtatcatcaaatggggtgacccagttactcgagttctagatgatggggagctgctggtgcagcagactaagaacagtgaccgcacaccattggtcagcgtgcttctggaaggtgagaatgaatgaggagatggcattaaaagttaaaggaaaaaaagcagcattttttaaaagcccgtaagcacattctagaaaagtgaattctttttcgtttttaaccttgttcttgatctgaaaatagtaatccaatctatgtaccaatattgtgtacaaattaaaattttcttggggtagaatgttagtgaggaaagatagcaactagttttcttgtaggattatatctgtatttctgtggcacttaatacactgaatgatgccacttagcctcaattcaattaaataaatacttactgagtacttgtattttagtcattgaactagttgctggggatacaaagacattcaagtgttcattcagtctggtcatgaacaaagacagtgtaaagaaattcctgactacggtgtatgtgtgtaaaggtgtgtgtgaatacaagtcatttagcataggggtggtcagggaaaactagagatgctatttaatctaggccttgaaagaccagttaggattttattgagtagacagacaaaaggggaaggacattccattcacaaataattaatttacagttataattagtatgacggcagaaaagttcagtgaggccccatgacaagggaacctaactacctctaaaggtctgggggatgagagctccctgggagaaacatattaagccatgacttgaccaatgaggagactctggccagccaaagtcactggggaggatgtttgaggcagagcatgtgaaaaagtcctgggcaggaaggagcttgaaagagaaagggagattatcctgacatgagactgtagaagcagatagaagccagttcatataaaaccctgtaggccatattaaagatttaaactatcttaggggcaatgggaagccatttgtaggattttaagcagtgaagccacatcatcatcactgctttatgatggagaatggattggaggggcaaaaagatacagaagagactaatggttagaagcagttggattagtcttaatgagagtcgattgtggtttgaagtatgtggagtagtgtagatggagataagtagactaattagaaatatttagaagatagaataaaaatgacctcattattattgtcaatcataattatgctagcagtttttgagcccttgctatttgccagtcactctactagcactgtgcacatattatctatttaaaccccacttcagtcctccaagggtagatgctgctgttgtctctattttgtaggtggggaagctgaagcctagaaatatttgttagattggatgtgggcagaggtatcaaacatgaccccctgggttctggcatacatagcccgataaatggtgctgtttactaagattgggaacactaatggaaagcagatttctggaagaaagatgatgagttcagttttgaacatgttaaattcaagggtcatataggagaagtaaatcggaaatgttgagcagcctgttggatatgtgggtctggctagcagtagactcatgagttgccagtatatagactgtggttgaagccatgggagtgaacgaaatcacttacagtgagggtgtgggttgagacgaaaaggaggcctagaacttgtctctgaagcatgttaacacgtaaggactaaacagagcagaaaaattgacaaaagagactgagcaagagtaaccagagaggaaaggggaaagagagaatgtgtgttacagaagccaagaaaagaaacatattttaagaaagaggggaattatgaattgtatcaaatgctcctaagaggctgaaaaagataccaaaatgtttgttgggtttgatgacatggagatcatttgtgaccttgatgggagcctgttcagtgtaatggggatgggagccgtaagatttagtgaggatgggtgggaggtgaagaacaaaagcagccagtgtaaataattacataggcaagttccattttgaagggagaagaaggtgcagttttgaggggtatgatgttcagaaagagttttttgttgttatgtattaaactgtcagatagactagaacatgctaaaacacttttggaaaggcttcagggaagaggaagaagtcgaacatatgggagaaaggaacaatcagtaatgtcatgttcctgagaagatggaaaggaagatttgattggtttatggttgaacgagggacacagcttccaaaacagggaagggaaggcagggatgtctaaatgtaggtaagttcgtagatttgcttgcctttatgagaaggcctgagtctttagaattctaactttttacatcacatttgcttctaataaggcagttttcccctgcccccaatatcagctcttaagattgtctttttttgttagacaaatgatttgatagaactaacaacataagtactaatatgcatttgaatgcgttcttttaagaagcaaaacccttacactctgtatattttgccaaaagtttgaaagattaaggatatgtgagaatgtcaggaggcatgtatttcaccatacttttgagaaatgctaattagttcattaagtttagttgctaataaataagagaaaacatgtctgctgtgaaattgtgtcaggaaatgttaatgagcaactagtcgagacctcagtatgttctggataaaagtttaaacttgttttatttccctttgcttaggttggcttttttcccctgacttgctcatatctttatgcaggccctcctcacagtgggaagactgctttagctgcaaaaattgcagaggaatccaacttcccgttcatcaagatctgttctcctgataaaatgattggcttttctgaaacagccaaatgtcaggccatgaagaaggtatcaagattttactttcattttaatttcctatctcttaaatgtgtgtgtgtgtgcacatatatatgcctttgtacatgtatacatataaacccatagcaactatgttcttctcaagtggaaccaaattatcagcagaatatgggggaagcagtgactgttttagattttctaactttgtaatgtattttattgagtacctttaccttctaaattatgctttgtttaatacatattaagtttcattgcctagttttgtatcaatttgattaaaagagttatagttgaaagtgtttgaataaagtggacaaattcatttaggattttttaaagttctttcattattgtacaaagttgaactctttggggtcaattaagttgaggaagacagagatgtatcaatgggaaaatagtcccaggaatccctacaaaaggatagttttatattaggtaataatcagaatctgcttggtaacttaatgcagttctcatacatcttcctttctccaagtgccactcgtcaccttcttaattaacatggccactttctaccatcagtgaagttagaacagcatagaatagaatcctagagctgaaaagactgtaagaccatttggtccatctctcttacattcaagcaagtgccatgcaacaacaacaacaaaaatcaatgatgaagactctaaatgg
